United States Patent
Raab et al.

(10) Patent No.: US 9,249,474 B2
(45) Date of Patent: Feb. 2, 2016

(54) CONSOLIDATED PRETREATMENT AND HYDROLYSIS OF PLANT BIOMASS EXPRESSING CELL WALL DEGRADING ENZYMES

(75) Inventors: R. Michael Raab, Arlington, MA (US); Dongcheng Zhang, Newton, MA (US); Oleg Bougri, Boise, ID (US)

(73) Assignee: Agrivida, Inc., Medford, MA (US)

(*) Notice: Subject to any disclaimer, the term of this patent is extended or adjusted under 35 U.S.C. 154(b) by 0 days.

(21) Appl. No.: 13/414,627

(22) Filed: Mar. 7, 2012

(65) Prior Publication Data

US 2012/0258503 A1     Oct. 11, 2012

Related U.S. Application Data

(63) Continuation-in-part of application No. 12/590,444, filed on Nov. 6, 2009, now Pat. No. 8,420,387, and a continuation-in-part of application No. 13/004,713, filed on Jan. 11, 2011, now Pat. No. 8,247,647, and a continuation-in-part of application No. PCT/US2010/055746, filed on Nov. 5, 2010, which is a continuation-in-part of application No. 12/590,444, application No. 13/414,627, which is a continuation-in-part of application No. PCT/US2010/055669, filed on Nov. 5, 2010, which is a continuation-in-part of application No. 12/590,444, application No. 13/414,627, which is a continuation-in-part of application No. PCT/US2010/055751, filed on Nov. 5, 2010, which is a continuation-in-part of application No. 12/590,444.

(60) Provisional application No. 61/449,769, filed on Mar. 7, 2011, provisional application No. 61/280,635, filed on Nov. 6, 2009, provisional application No. 61/398,589, filed on Jun. 28, 2010.

(51) Int. Cl.
| | |
|---|---|
| *C12N 9/42* | (2006.01) |
| *C12N 15/82* | (2006.01) |
| *C12N 9/24* | (2006.01) |
| *C12P 19/14* | (2006.01) |

(52) U.S. Cl.
CPC ......... *C12Y 302/01004* (2013.01); *C12N 9/248* (2013.01); *C12N 9/2437* (2013.01); *C12N 15/8216* (2013.01); *C12N 15/8246* (2013.01); *C12P 19/14* (2013.01); *C12Y 302/01008* (2013.01); *Y02E 50/10* (2013.01); *Y02E 50/30* (2013.01)

(58) Field of Classification Search
None
See application file for complete search history.

(56) References Cited

U.S. PATENT DOCUMENTS

| | | |
|---|---|---|
| 5,432,074 A | 7/1995 | Evans et al. |
| 5,496,714 A | 3/1996 | Comb et al. |
| 5,654,184 A | 8/1997 | Curtiss et al. |
| 5,780,708 A | 7/1998 | Lundquist et al. |
| 5,834,247 A | 11/1998 | Comb et al. |
| 5,981,835 A | 11/1999 | Austin-Phillips et al. |
| 6,013,863 A | 1/2000 | Lundquist et al. |
| 6,022,846 A | 2/2000 | Van Ooijen et al. |
| 6,160,208 A | 12/2000 | Lundquist et al. |
| 6,395,966 B1 | 5/2002 | Mumm et al. |
| 6,531,316 B1 | 3/2003 | Patten et al. |
| 6,800,792 B1 | 10/2004 | Howard et al. |
| 6,858,775 B1 | 2/2005 | Xu et al. |
| 6,933,362 B1 | 8/2005 | Belfort et al. |
| 7,049,485 B2 | 5/2006 | Sticklen et al. |
| 7,102,057 B2 | 9/2006 | Lanahan et al. |
| 7,186,898 B1 | 3/2007 | Kossmann et al. |
| 7,361,806 B2 | 4/2008 | Lebel et al. |
| 7,557,262 B2 | 7/2009 | Lanahan et al. |
| 7,709,697 B2 | 5/2010 | Raab |
| 7,741,530 B2 | 6/2010 | Snell |
| 7,838,732 B2 | 11/2010 | Lebel et al. |
| 7,855,322 B2 | 12/2010 | Lanahan et al. |
| 7,906,704 B2 | 3/2011 | Raab et al. |
| 7,919,681 B2 | 4/2011 | Lanahan et al. |
| 7,919,682 B2 | 4/2011 | Frohberg et al. |
| 8,093,456 B2 | 1/2012 | Sticklen |
| 8,101,393 B2 * | 1/2012 | Gray et al. ............ 435/209 |
| 8,247,647 B2 | 8/2012 | Raab |
| 8,257,502 B2 | 9/2012 | Frohberg et al. |
| 8,343,747 B2 | 1/2013 | Burke et al. |
| 8,455,715 B2 * | 6/2013 | Paul et al. ............ 800/278 |
| 8,481,810 B2 | 7/2013 | Lebel et al. |
| 8,664,476 B2 | 3/2014 | Raab |
| 2002/0138878 A1 | 9/2002 | Sticklen et al. |

(Continued)

FOREIGN PATENT DOCUMENTS

| | | |
|---|---|---|
| CN | 101283092 A | 10/2008 |
| CN | 101979548 A | 2/2011 |

(Continued)

OTHER PUBLICATIONS

J.R. Hess et al., Roadmap for Agricultural Biomass Feedstock Supply in the United States, 2003, DOE/NE-11129.

(Continued)

*Primary Examiner* — Brent T Page
(74) *Attorney, Agent, or Firm* — Volpe and Koenig, P.C.

(57) ABSTRACT

Methods for consolidated pretreatment and hydrolysis of genetically engineered plants expressing cell wall degrading enzymes are provided. Expression cassettes and vectors for making transgenic plants are described. Plants engineered to express one or more cell wall degrading enzymes using expression cassettes and vectors of the invention are also provided.

35 Claims, 29 Drawing Sheets

(56) References Cited

U.S. PATENT DOCUMENTS

| | | | |
|---|---|---|---|
| 2003/0159182 | A1 | 8/2003 | Tackaberry et al. |
| 2003/0167533 | A1 | 9/2003 | Yadav et al. |
| 2003/0233675 | A1 | 12/2003 | Cao et al. |
| 2004/0123343 | A1 | 6/2004 | La Rosa et al. |
| 2005/0125860 | A1 | 6/2005 | Raab et al. |
| 2005/0283850 | A1 | 12/2005 | Snell et al. |
| 2006/0179513 | A1 | 8/2006 | Sticklen et al. |
| 2007/0192900 | A1 | 8/2007 | Sticklen et al. |
| 2007/0218530 | A1* | 9/2007 | Duck et al. .............. 435/101 |
| 2007/0250961 | A1 | 10/2007 | Blaylock et al. |
| 2008/0115243 | A1 | 5/2008 | Raab et al. |
| 2008/0220125 | A1 | 9/2008 | Abbas et al. |
| 2009/0119800 | A1 | 5/2009 | Lanahan et al. |
| 2009/0155238 | A1 | 6/2009 | Weiner et al. |
| 2009/0193541 | A1 | 7/2009 | Miles |
| 2009/0258930 | A1 | 10/2009 | Pachuk et al. |
| 2009/0298149 | A1 | 12/2009 | Wang et al. |
| 2009/0320831 | A1 | 12/2009 | Lanahan et al. |
| 2010/0124771 | A1* | 5/2010 | Sabesan et al. ............ 435/101 |
| 2010/0143967 | A1 | 6/2010 | McFarland |
| 2010/0159494 | A1 | 6/2010 | Sweeney et al. |
| 2010/0159510 | A1 | 6/2010 | Raab |
| 2010/0159520 | A1 | 6/2010 | Diner et al. |
| 2011/0045127 | A1 | 2/2011 | Ral et al. |
| 2011/0111442 | A1 | 5/2011 | Shen et al. |
| 2012/0040409 | A1* | 2/2012 | Hau et al. .................. 435/99 |
| 2012/0054915 | A1 | 3/2012 | Steffens |
| 2012/0258503 | A1 | 10/2012 | Raab et al. |
| 2013/0318655 | A1 | 11/2013 | Raab |

FOREIGN PATENT DOCUMENTS

| | | |
|---|---|---|
| EP | 0602899 A2 | 6/1994 |
| JP | 70200 | 3/1995 |
| WO | 9701642 A1 | 1/1997 |
| WO | 9821348 A1 | 5/1998 |
| WO | 0005381 A2 | 2/2000 |
| WO | 0036093 A2 | 6/2000 |
| WO | 0052155 A2 | 9/2000 |
| WO | 0071701 A1 | 11/2000 |
| WO | 0157183 A2 | 8/2001 |
| WO | 0159091 A2 | 8/2001 |
| WO | 03050265 A2 | 6/2003 |
| WO | 03056904 A2 | 7/2003 |
| WO | 2005095618 A2 | 10/2005 |
| WO | 2005095619 A1 | 10/2005 |
| WO | 2007100897 A2 | 9/2007 |
| WO | 2007146944 A2 | 12/2007 |
| WO | 2008064314 A2 | 5/2008 |
| WO | 2009067751 A1 | 6/2009 |
| WO | 2009155601 A2 | 12/2009 |
| WO | 2010060056 A2 | 5/2010 |
| WO | 2010096510 A2 | 8/2010 |
| WO | 2011057159 A2 | 5/2011 |
| WO | 2011163659 A2 | 12/2011 |

OTHER PUBLICATIONS

J.W.A. Langeveld, et al., "Development Perspectives of the Biobased Economy: a Review," Crop Science, 2010, 50: S131-S151.

P. Alvira, et al., "Pretreatement Technologies for an Efficient Bioethanol Production Process Based on Enzymatic Hydrolysis: A Review," Bioresource Biotechnology, 2010, 101: 4851-4861.

Miron Abramson, et al., "Plant Cell Wall Reconstruction Toward Improved Lignocellulosic Production and Processability," Plant Science, 2010, 178: 61-72.

Daniel Klein-Marcuschamer, et al., The Challenge of Enzyme Cost in the Production of Lignocellulosic Biofuels, 2012, 109:1083-1087.

Li Zhu, et al., "Structural Features Affecting Biomass Enzymatic Digestability," Bioresource Biotechnology, 2008, 99: 3817-3828.

Charles E. Wyman, et al., "Coordinated Development of Leading Biomass Pretreatment Technologies," Bioresource Biotechnology, 2005, 96:1959-1966.

Nathan Mosier, et al., "Features of Promising Technologies for Pretreatment of Lignocellulosic Biomass," Bioresource Biotechnology, 2005, 96: 673-686.

Mark D. Harrison, et al., "Accumulation of Recombinant Cellobiohydrolase and Endoglucanase in the Leaves of Mature Transgenic Sugar Cane," Plant Biotechnology Journal, 2011, 9: 884-896.

Shyamala Hedge, et al. "Single-Step Synthesis of 4-nitrophenyl Ferulate for Spectrophotometric Assay of Feruloyl Esterases," Analytical Biochemistry, 2009, 387(1): 128-129.

Sandum Fernando, et al., "Biorefineries: Current Status, Challenges, and Future Direction," Energy & Fuels, 2006, 1727-1737.

M. Galbe, et al., "A Review of the Production of Ethanol from Softwood," Applied Microbiology Biotechnology, 2002, 59:618-628.

J.Y. Zhu, et al., "Pretreatment of Woody Biomass for Biofuel Production: Energy Efficiency, Technologies, and Recalcitrance," Applied Microbiology & Biotechnology, 2010, 87(3):847-857.

Jeffrey G. Linger et al., "Heterologous Expression and Extracellular Secretion of Cellulolytic Enzymes of *Zymomonas mobilis*," Applied and Environmental Mirobiology, 2010, 76(19):6360-6369.

Callista Ransom, et al., "Heterologous Acidothermus cellulolyticus 1,4,β-Endoglucanase E1 Produced Within the Corn Biomass Converts Corn Stover Into Glucose," Applied Biochemistry and Biotechnology, 2007, 36:207-220.

Seung-Hwan Lee, et al., "Enzymatic Saccharification of Woody Biomass Micro/Nanofibrillated by Continuous Extrusion ProcessII: Effect of Hot-Compressed Water Treatment," Bioresource Technology, 2010, 101(24):9645-9649.

Jiele Xu and Jay J. Cheng, "Pretreatment of Switchgrass for Sugar Production with the Combination of Sodium Hydroxide and Lime," Bioresource Technology, 2011, 102(4):3861-3868.

Pradeep Verma, et al., Microwave Assisted Pretreatment of Woody Biomass with Ammonium Molibdate Activated by $H_2O_2$, Bioresource Technology, 2011, 102(4):3941-3945.

Jijiao Zeng, et al., "Biological Pretreatment of Wheat Straw by Phanerochaete chrysosporium Supplemented with Inorganic Salts," Bioresource Technology, 2011, 102(3) 3206-3214.

D. Negrotto, et al., "The Use of Phosphomannose-Isomerase As a Selectable Marker to recover Transgenic Maize plants (*Zea mays* L) via Agrobacterium transformation," Plant Cell Reports, 2000, 19 (8): 798-803.

Yukon Hiei, et al., "Efficient Transformation of Rice (*Oryza sativa* L.) mediated by Agrobacterium and sequence analysis of the boundaries of the T-DNA,"The Plant Journal, 1994, 6(2): 271-282.

Yukon Hiei and Toshihiko Komari, "Improved Protocols for Transformation of Indica Rice Mediated by Agrobacterium tumefaciens," 2006 Plant Cell Tissue and Organ Culture, 2006, 85: 271-283.

Toshihiko Komari, et al., "Vectors Carrying Two Separate T-DNAs for Co-transformation of Higher Plants Mediated by Agrobacterium tumefaciens and Segregations of Trsnformants Free From Selection Markers," The Plant Journal, 199, 10(1): 165-174.

Benjamin N. Gray, et al., "Global and Grain-Specific Accumulation of Glycoside Hydrolase Family 10 Xylanases in Transgenic Maize (*Zea mays*)," Plant Biotechnology Journal, 2011, 9:1100-1108.

Li Liu, et al. "Enhanced Enzymatic Hydrolysis and Structural Features of Corn Stover by FeCl3 Pretreatment," Bioresource technology, 2009, 100(23): 5853-5858.

Ziyu Dai, et al., "Improved Plant-Based Production of E1 Endoglucanase Using Potato: Expression Optimization and Tissue Targeting," Molecular Breeding, 2000, 6:277-285.

Minesh Patel, et al., "Transgenic Barley Expressing a Fungal Xylanase Gene in the Endosperm of the Developing Grains," Molecular Breeding, 2000, 6:113-123.

Matthew T. Ziegler, et al., "Accumulation of a Thermostable Endo-1,4-β-D-glucanase in the Apoplast of Arabidopsis thaliana Leaves," Molecular Breeding, 2000, 6:37-46.

Thomas Ziegelhoffer, et al., "Expression of Bacterial Cellulase Genes in Transgenic Alfalfa (*Medicago sativa* L.), potato (*Solanum tuberosum* L.) and tobacco (*Nicotiana tabacum*)," Molecular Breeding, 1999, 5: 309-318.

(56) References Cited

OTHER PUBLICATIONS

Thomas Ziegelhoffer, et al., "dramatic Effects of Truncation and Sub-cellular Targeting on the Accumulation of recombinant Microbial Cellulase in Tobacco," Molecular Breeding, 2001, 8: 147-158.
Peilong Yang, et al., Expression of Xylanase with High Specific Activity from *Streptomyces olivaceoviridis* A1 in Transgenic Potato Plants (*Solanum tuberosum* L.), Biotechnology Letters, 2007, 29: 659-667.
Kierston Shill, et al., "Ionic Liquid Pretreatment of Cellulosic Biomass: Enzymatc Hydrolysis and Ionic Liquid Recycle," Biotechnology and Bioengineering, 2011, 108(3): 511-520.
Rafael Montalvo-Rodriguez, et al., "Autohydrolysis of Plant Polysaccharides Using Transgenic Hyperthermophilic Enzymes," Biotechnology and Bioengineering, 2000, 70(2): 151-159.
Goutami Banerjee and John S. Scott-Craig, "Improving Enzymes for Biomass Conversion: A Basic Research Perspective," BioEnergy Research, 2010, 3: 82-92.
Roman Brunecky, et al., "In planta Expression of *A. celluloticus* Cel5A Endocellulase Reduces Cell Wall Recalcitrance in Tobacco and Maize," Biotechnology for Biofuels, 2011, 4: 1-10.
Mariam B. Sticklen, "Plant Genetic Engineering for Biofuel Production: Towards Affordable Cellulosic Ethanol," Nature Reviews: Genetics, 2008, 9: 433-443.
Yuji Ishida, et al.,"High Efficiency Transformation of Maize (*Zea mays* L.) Mediated by Agrobacterium Transformation," Nature Biotechnology, 1996, 14: 745-750.
K. Herbers, et al., "A Thermostable Xylanase from Clostridium thermocellum Expressed at High Levels in the Apoplast of Transgenic Tobacco Has No Detrimental Effects and Is Easily Purified," Nature Biotechnology, 1995, 13:63-66.
Manuel B. Sainz, "Commercial Cellulosic Ethanol: The Role of Plant-Expressed Enzymes," In Vitro Cellular and Developmental Biology, 2009, 45: 314-329.
Ziyu Dai, et al., "Expression of Acidothermus cellulolyticus E1 in Transgenic Tobacco: Biochemical Characteristics and Physiological Effects," Transgenic Research, 2000, 9:43-54.
Hesham Oraby, et al., "Enhanced Conversion of Plant Biomass Into Glucose Using Transgenic Rice-Produced Endoglucanase for Cellulosic Ethanol," Transgenic Research, 2007, 16:739-749.
Tetsuya Kimura, et al., "Stable Expression of a Thermostable Xylanase of Clostridium thermocellum in Cultured Tobacco Cells," Journal of Bioscience and Bioengineering, 2003, 95(4): 397-400.
Bae Hyunjong, et al., Dual Targeting of Xylanase to Chloroplasts and Peroxisomes as a Means to Increase Protein Accumulation in Plant Cells, Journal of Experimental Botany, 2006, 57 (1): 161-169.
Gadab C. Ghosh Biswas, et al., "Expression of Biologically Active Acidothermus cellulolyticus Endoglucanase in Transgenic Maize Plants," Plant Science, 2006, 617-623.
Bernhard Borkhardt, et al., "Autohydrolysis of Plant Xylans by Apoplastic Expression of Thermophilic Bacterial Endo-Xylanases," Plant Biotechnology Journal, 2010, 8: 363-374.
Yuji Ishida, et al., "Agrobacterium—Mediated Transformation of Maize," Nature Protocols, 2007, 2(7):1614-1621.
Yong Woo Park, et al., "Enhancement of Growth and Cellulose Accumulation by Overexpression of Xyloglucanase in Poplar," FEBS Letters, 2004, 564: 183-187.
Daniel D. Morris, et al., "Cloning of the xynB Gene from *Dictyoglomus thermophilum* Rt46B.1 and Action of the Gene Product on Kraft Pulp," Applied and Environmental Microbiology, 1998, 64(5):1759-1765.
Ingrid Lindh, et al., "Production of the p24 Capsid Protein from HIV-1 Subtype C in Arabidopsis thaliana and Daucus carota Using an Endoplasmic Recticulum-Directing Sekdel sequence in Protein Expression Constructs," Protein Expression and Purification, 2009, 66(1): 46-51.
Elizabeth E. Hood et al., "Subcellular Targeting is a Key Condition for High-Level Accumulation of Cellulase Protein in Transgenic Maize Seed," Plant Biotechnology Journal, 2007, 5: 709-719.

Dylan Dodd and Isaac K. O. Cann, "Enzymatic Deconstruction of Xylan for Biofuel Production," Global Change Biology Bioenergy, 2009, 1(1):2-17.
Altintas, M. M., et al, "Improvement of Ethanol Production from Starch by Recombinant Yeast Through Manipulation of Environmental Factors," Enzyme and Microbial Technology, vol. 31, No. 5, 2002, pp. 640-647.
Aspegren, K., et al., "Secretion of Heat-Stable Fungal .beta.-Glucanase from Transgenic, Suspension-Cultured Barley Cells," Molecular Breeding, 1995, pp. 91-99.
Birch, R.G., Plant Transformation: Problems and Strategies for Practical Application, Annual Review of Plant Physiology and Plant Molecular Biology, vol. 48, Jun. 1997, pp. 297-326.
Bird, C.R., et al., The Tomato Polygalacturonase Gene and Ripening-Specific Expressions in Transgenic Plants, Plant Molecular Biology, 1988, pp. 651-662.
Brederode, F.T., et al., Complete Nucleotide Sequence of Alfalfa Mosaic Virus RNA 4, Nucleic Acids Research, vol. 8, No. 10, 1980, pp. 2213-2223.
Broothaerts, W., et al., "Gene Transfer to Plants by Diverse Species of Bacteria," Nature, vol. 433, Feb. 2005, pp. 629-633.
Bult et al., (1996) Complete genome sequence of the methanogenic archaeon, Methanococcus jannaschii. Science 273(5278): 1058-73.
Cambon-Bonavita et al., (2000) Cloning, expression, and characterization of DNA polymerase I from the hyperthermophilic archaea Thermococcus fumicolans. Extremophiles 4(4): 215-25.
Cameron, D.C., et al., "Metabolic Engineering of Propanediol Pathways," Biotechnology Progress, 1998, pp. 116-125.
Chen et al., "Herbicide Resistance from a Divided EPSPS Protein: The Split Synechocystis DnaE Intein as an In Vivo Affinity Domain", Gene: An International Journal of Genes and Genomes, vol. 263, pp. 39-48 (2001).
Chen et al., (2000) Protein splicing in the absence of an intein penultimate histidine. J Biol Chem 275(27): 20431-5.
Cheon, B.Y., et al., "Ovexpression of Human Erythropoietin (EPO) Affects Plant Morphologies: Retarded Vegetative Growth in Tobacco and Male Sterility in Tobacco and Arabidopsis," Transgenic Research, 2004, pp. 541-549.
Chih-Ching, C., et al., "Establishment of an Efficient Medium for Anther Culture of Rice Through Comparative Experiments on the Nitrogen Sources," Scientia Sinica, vol. 18, No. 3, 1975, pp. 659-668.
Chin et al., Protein trans-splicing in transgenic plant chloroplast: Reconstruction of herbicide resistance from split genes, PNAS, vol. 100, No. 8, pp. 4510-4515 (2003).
Chong et al., "Modulation of Protein Splicing of the *Saccharomyces cerevisiae* Vacuolar Membrane ATPase Intein," The Journal of Biological Chemistry, vol. 273, No. 17, pp. 10567-10577 (Apr. 24, 1998).
Chong, et al. ., "Single-column purification of free recombinant proteins using a self-cleavable affinity tag derived from a protein splicing element", Gene: An International Journal of Genes Genomes, vol. 192, pp. 271-281 (1997).
Chute et al., (1998) A topA intein in Pyrococcus furiosus and its relatedness to the r-gyr intein of Methanococcus jannaschii. Gene 210(1): 85-92.
Clarke, Neil D., "A Proposed Mechanism for the Self-Splicing of Proteins," Proceedings of the National Academy of Science, USA, vol. 91, pp. 11084-11088, Nov. 1994.
Coruzzi, G., et al., "Tissue-Specific and Light-Regulated Expression of Pea Nuclear Gene Coding the Small Subunit of Ribulose-1, 5-Bisphosphate Carboxylase," The EMBO Journal, 1984, 1671-1679.
Bae et al. "Production of Recombinant Xylanase in Plants and its Potential for Pulp Biobleaching Applications," Bioresource Technology, Elseview, BV, GB, vol. 99, No. 9, 22 (Aug. 22, 2008), pp. 3513-3519.
Hood, E.E., et al., "Commercial Production of Avidin from Transgenic Maize: Characterization of Transformant, Production, Processing, Extraction and Purification," Molecular Breeding, 1997, pp. 291-306.
Dale, Bruce E., "Biobased Industrial Products: Bioprocess Engineering When Costs Really Count," Biotechnology Progress, 1999, pp. 775-776.

(56) References Cited

OTHER PUBLICATIONS

Dalgaard et al., (1997) Statistical modeling, phylogenetic analysis and structure prediction of a protein splicing domain common to inteins and hedgehog proteins. J Comput Biol 4(2): 193-214.
Davis, E., et al., "Novel Structure of the recA Locus of *Mycobacterium tuberculosis* Implies Processing of the Gene Product," Journal of Bacteriology, vol. 173, No. 18, Sep. 1991, pp. 5653-5662.
Davis, E., et al., "Protein Splicing in the Maturation of *M. tuberculosis* RecA Protein: A Mechanism for Tolerating a Novel Class of Intervening Sequence," Cell Press, vol. 71, Oct. 16, 1992, pp. 201-210.
Davis et al., "Protein Splicing: The Lengths Some Proteins Will Go to" 1995, Antonie van Leeuwenhoek, vol. 67, pp. 131-137.
Deckert et al., (1998) The complete genome of the hyperthermophilic bacterium *Aquifex aeolicus*. Nature. 392(6674): 353-8.
Derbyshire, et al., "Lightning Strikes Twice: Intron-Intein Coincidence," Proceedings of the National Academy of Science, USA, vol. 95, pp. 1356-1357, Feb. 17, 1998.
Evans et al., "Semisynthesis of Cytotoxic Proteins Using a Modified Protein Splicing Element," Protein Science, vol. 7: pp. 2256-2264.
Evans et al., (1999) The in vitro ligation of bacterially expressed proteins using an intein from Methanobacterium thermoautotrophicum. J Biol Chem 274(7): 3923-6.
Gangopadhyay, J.P., et. al., "In Vitro Splicing of Erythropoietin by the *Mycobacterium tuberculosis* RecA Intein Without Substituting Amino Acids at the Splice Junctions," Biochimica et Biophysica Acta, vol. 1619, (2003), pp. 193-200.
Genschik et al., (1997) The human RNA 3'-terminal phosphate cyclase is a member of a new family of proteins conserved in Eucarya, Bacteria and Archaea. Embo J. 16(10): 2955-67.
Genschik et al., (1998) Characterization of the *Escherichia coli* RNA 3'-terminal phosphate cyclase and its sigma54-regulated operon. J Biol Chem. 273(39): 25516-26.
Gimble, "Invasion of a Multitude of Genetic Niches by Mobile Endonuclease Genes" Feb. 8, 2000, FEMS Microbiology Letters, vol. 185, pp. 99-107.
Gordon-Kamm, et al., "Transformation of Maize Cells and Regeneration of Fertile Transgenic Plants," The Plant Cell, vol. 2, pp. 603-618, Jul. 1990.
Guilley, H., et al., "Transcription of Cauliflower Mosaic Virus DNA: Detection of Promoter Sequences, and Characterization of Transcripts," Cell, vol. 30, Oct. 1982, pp. 763-773.
Gupta, P.K., et al., "Shoot Multiplication from Mature Trees of Douglas Fir and Sugar Pine," Plant Cell Reports, vol. 4, 1985, pp. 177-179.
Hashimoto et al., (2000) Crystallographic study of intein homing endonuclease II encoded in the archaeal DNA polymerase gene. Acta Crystallogr D Biol Crystallogr 56((Pt 9)): 1185-6.
Hashimoto et al., (2001) Crystal structure of DNA polymerase from hyperthermophilic archaeon *Pyrococcus kodakaraensis* KOD1. J Mol Biol 306(3): 469-77.
Higgins, T.J.V., Synthesis and Regulation of Major Proteins in Seeds, Annual Review of Plant Physiology, 1984, pp. 191-221.
Hirata, R., et al., "Molecular Structure of the Gene, VMA1, Encoding the Catalytic Subunit of H.sup.+-Translocating Adenosine Triphosphatase fro Vacuolar Membranes of *Saccharomyces cerevisiae*," The Journal of Biological Chemistry, vol. 265, No. 12, Apr. 25, 1990, pp. 6826-6733.
Hodges et al., (1992) Protein splicing removes intervening sequences in an archaea DNA polymerase. Nucleic Acids Res 20(23): 6153-7.
Ingram, L.O., et al., "Enteric Bacterial Catalysts for Fuel Ethanol Production," Biotechnology Progress, 1999, pp. 856-866.
Kane, P.M., et. al., "Protein Splicing Converts the Yeast TFP1 Gene Product to the 69-kD Subunit of the Vacuolar H+-Adenosine Triphosphatase," Science, New Series, vol. 250, No. 4981, Nov. 2, 1990, pp. 651-657.
Kawarabayasi et al., (1998) Complete sequence and gene organization of the genome of a hyper-thermophilic archaebacterium, Pyrococcus horikoshii OT3. DNA Res 5(2):55-76.
Kawarabayasi et al., (1998B) Complete sequence and gene organization of the genome of a hyper-thermophilic archaebacterium, Pyrococcus horikoshii OT3 (supplement). DNA Res. 5(2): 147-55.
Kawarabayasi et al., (1999) Complete genome sequence of an aerobic hyper-thermophilic crenarchaeon, Aeropyrum pernix K1. DNA Res. 6(2): 83-101, 145-52.
Kawarabayasi, Y. (2001) Genome of Pyrococcus horikoshii OT3. Methods Enzymol. 330: 124-34.
Kawashima et al., (1999) Determination of the complete genomic DNA sequence of Thermoplasma volvanium GSS1. Proc. Jpn. Acad 75: 213-218.
Klabunde et al., (1998) Crystal structure of GyrA intein from *Mycobacterium xenopi* reveals structural basis of protein splicing. Nat Struct Biol 5(1): 31-6.
Sreenath, H.K., et al., "Production of Ethanol from Wood Hydrolyzate by Yeasts," Bioresource Technology, vol. 72, No. 3, 2000, pp. 253-260.
Staub, J.M., et al., "High-Yield Production of a Human Therapeutic Protein in Tobacco Chloroplasts," Nature Biotechnology, vol. 18, Mar. 2000, pp. 333-338.
Stoddard et al., (1998) Breaking up is hard to do. Nat Struct Biol 5(1): 3-5.
Sun et al., "Protein trans-Splicing to Produce Herbicide-Resistant Acetolactate Synthase," Applied and Environmental Microbiology, vol. 67, No. 3, pp. 1025-1029 (Mar. 2001).
Tague, B.W., et al., "A Short Domain of the Plant Vacuolar Protein Phytohemagglutinin Targets Invertase to the Yeast Vacuole," The Plant Cell, vol. 2, Jun. 1990, pp. 533-546.
Takagi et al., (1997) Characterization of DNA polymerase from *Pyrococcus* sp. strain KOD1 and its application to PCR. Appl Environ Microbiol 63(11): 4504-10.
Taylor, F., et al., "Dry-Grind Process for Fuel Ethanol by Continuous Fermentation and Stripping," Biotechnology Progress, vol. 16, 2000. pp. 541-547.
Telenti et al., (1997) The *Mycobacterium xenopi* GyrA protein splicing element: characterization of a minimal intein. J Bacteriol 179(20): 6378-82.
Tingey, S.V., et al., "Glutamine Synthetase Genes of Pea Encode Distinct Polypeptides Which are Differentially Expressed in Leaves, Roots and Nodules," The EMBO Journal, vol. 6, No. 1, 1987, pp. 1-9.
Ulgen, K.O., et. al., "Bioconversion of Starch Into Ethanol by a Recombinant *Saccharomyces cerevisiae* Strain YPG-AB" Process Biochemistry, vol. 37, 2002, pp. 1157-1168.
Van Den Broeck, G., et al., Targeting of a Foreign Protein to Chloroplasts by Fusions to the Transmit Peptide from the Small Subunit of Ribulose 1,5-Bisphosphate Carboxylase, Nature, vol. 313, Ksmistu 1985, pp. 358-363.
Von Heijne, G., "Towards a Comparative Anatomy of N-Terminal Topogenic Protein Sequences," Journal of Molecular Biology, vol. 189, 1986, pp. 239-242.
Wallace, "The Curious Case of Protein Splicing: Mechanistic Insights Suggested by Protein Semisynthesis," Protein Science, vol. 2, pp. 697-705 (1993).
Wang et al., "Identification of an Unusual Intein in Chloroplast ClpP Protease of Chlamydomonas Eugametos" May 2, 1997, Journal of Biological Chemistry, vol. 272, No. 18, pp. 11869-11873.
Wenzler, H.C., et al., "Analysis of a Chimeric Class-I Patatin-GUS Gene in Transgenic Potato Plants: High-Level Expression in Tubers and Sucrose-Inducible Expressions in Cultured Leaf and Stem Explants," Plant Molecular Biology, vol. 12, 1989, pp. 41-50.
Wood, D.W. et al., "Optimized Single-Step Affinity Purification with a Self-Cleaving Intein Applied to Human Acidic Fibroblast Growth Factor," Biotechnology Progress, vol. 16, 2000, pp. 1055-1063.
Xu, M., et al., "In Vitro Protein Splicing of Purified Precursor and the Identification of Branched Intermediate," Cell, vol. 75, Dec. 31, 1993, pp. 1371-1377.
Xu et al., (1994) Protein splicing: an analysis of the branched intermediate and its resolution by succinimide formation. Embo J 13(23): 5517-22.
Xu, M., et al., "The Mechanism of Protein Splicing in its Modulation by Mutation," The EMBO Journal, vol. 15, No. 19, 1996, pp. 5146-5153.

(56) References Cited

OTHER PUBLICATIONS

Yamazaki et al., (1998) Segmental isotope labeling for protein NMR using peptide splicing. J. Am. Chem. Soc. 120: 5591-5592.
Yang, et al., "Intein-mediated assembly of a functional .beta.-glucuronidase in transgenic plants," PNAS, vol. 100, No. 6, pp. 3513-3518 (2003).
Yumiko Obana et al., "Enhanced turnover of transitory starch by expression of up-regulated ADP-glucose pyrophosphorylases in Arabidopsis thaliana", Plant Science, vol. 170, 1-11, 2006.
Ryan, A.J., et al., Genomic Sequence of a 12S Seed Storage Protein from Oilseed Rape, Nucleic Acids Research, vol. 17, No. 9, 1989, p. 3584.
Ichiyanagi et al., (2000) Crystal structure of an archaeal intein-encoded homing endonuclease PI-PfuI. J Mol Biol 300 (4): 889-901. PubMed ID: 10891276.
Iwai et al., "Cyclic green fluorescent protein produced in vivo using an artificially split PIPfuI intein from Pyrococcus furiosus," J Biol Chem 276(19): 16548-54.
Mills et al., "Protein splicing in trans by purified N- and C-terminal fragments of the *Mycobacterium tuberculosis* RecA intein," Proc. Natl. Acad. Sci. USA, 1998, 95(7):3543-3548.
Mathys et al., "Characterization of a self-splicing mini-intein and its conversion into autocatalytic N- and C-terminal cleavage elements: facile production of protein building blocks for protein litigation," Gene, 1999, 231, pp. 1-13.
*Pyrococcus* sp. Deep Vent DNA Polymerase Precusor Gene (ncbi. nlm.gov/nuccore/436492), GenBank, May 24, 1995.
Wood et al., "A genetic system yields self-cleaving inteins for bioseparations", Nature Biotech, 1999, 17:889-892.
Morris et al. "Accession No. AAC46361, beta-1,4xylanase229B, [*Dictyoglomus thermophilum*]," Genbank, published Dec. 14, 2009.
Bhiri et al. "Accession No. AAT99321, cellobiohydrolase 1[*Penicillium occitanis*]," Genbank, published Oct. 8, 2008.
Klein, T.M., et al., "High-Velocity Microprojectiles for Delivering Nucleic Acids Into Living Cells," Nature, vol. 327, May 1987, pp. 70-73.
Komori et al., (1999) PI-PfuI and PI-PfuII, intein-coded homing endonucleases from Pyrococcus furiosus. I. Purification and identification of the homing-type endonuclease activities. Nucleic Acids Res 27(21): 4167-74.
Komori et al., (1999B) PI-PfuI and PI-PfuII, intein-coded homing endonucleases from Pyrococcus furiosus. II. Characterization of the binding and cleavage abilities by site-directed mutagenesis. Nucleic Acids Res 27(21): 4175-82.
Lai et al., "Structural Characterization of Human Erythropoietin." The Journal of Biological Chemistry, vol. 261, pp. 3116-3121, Mar. 5, 1986.
Latif, F., et al., "Production of Ethanol and Xylitol from Corn Cobs by Yeasts," Bioresource Technology, vol. 77, 2001, pp. 57-63.
Lecompte et al., (2001) Genome evolution at the genus level: comparison of three complete genomes of hyperthermophilic archaea. Genome Res. 11(6): 981-93.
Liu et al., (1997) A DnaB intein in Rhodothermus marinus: indication of recent intein homing across remotely related organisms. Proc Natl Acad Sci U S A 94(15): 7851-6.
Lynd, L.R., et al., "Biocommodity Engineering," Biotechnology Progress, vol. 15, 1999, pp. 777-793.
Maeder et al., (1999) Divergence of the hyperthermophilic archaea Pyrococcus furiosus and P. horikoshii inferred from complete genomic sequences. Genetics 152(4): 1299-305.
Mansfield, S.D., et al., "Substrate and Enzyme Characteristics that Limit Cellulose Hydrolysis," Biotechnology Progress, vol. 15, 1999, pp. 804-816.
Matsumoto, S., et al., "Characterization of Human Glycoprotein (Erythropoietin) Produced in Cultured Tobacco Cells," Plant Molecular Biology, 1995, pp. 1163-1172.
Morassutti et al., "Production of a Recombinant Antimicrobial Peptide in Transgenic Plants Using a Modified VMA Intein Expression System," FEBS Letters, vol. 519, Nos. 1-3, pp. 141-146 (Apr. 2002).

Murashige, T., et al., "A Revised Medium for Rapid Growth and Bio Assays with Tobacco Tissue Cultures," Physiologia Plantarum, vol. 15, pp. 473-497 (1962).
Niehaus et al., (1997) Cloning and characterisation of a thermostable alpha-DNA polymerase from the hyperthermophilic archaeon *Thermococcus* sp. TY. Gene 204(1-2): 153-8.
Nishioka et al., (1998) Characterization of two intein homing endonucleases encoded in the DNA polymerase gene of *Pyrococcus kodakaraensis* strain KOD1. Nucleic Acids Res 26(19): 4409-12.
Olsson, L., et al., "Fermentation of lignocellulosic Hydrolysates for Ethanol Production," Enzyme and Microbial Technology, vol. 18, 1996, pp. 312-331.
Otomo et al., (1999) Improved segmental isotope labeling of proteins and application to a larger protein. J Biomol NMR 14(2): 105-14.
Otomo et al., (1999B) NMR observation of selected segments in a larger protein: central-segment isotope labeling through intein-mediated ligation. Biochemistry 38(49): 16040-4.
Parsons, T.J., et al., "Transformation of Poplar by Agrobacterium Tumefaciens," Biotechnology, vol. 4, Jun. 1986, pp. 533-536.
Perler, et al. (1997) Compilation and analysis of intein sequences. Nucleic Acids Res 25(6): 1087-93.
Perler, "InBase: the Intein Database" Aug. 31, 2001, Nucleic Acids Research, vol. 30, No. 1. pp. 383-384.
Perler et al., (1992) Intervening sequences in an Archaea DNA polymerase gene. Proc Natl Acad Sci U S A. 89(12): 5577-81.
Perler, F.B., et al., "Protein Splicing Elements; Inteins and Exteins—A Definition of Terms and Recommended Nomenclature", Nucleic Acids Research, vol. 22, No. 7, Feb. 24, 1993, pp. 1125-1127.
Pietrokovski, "Conserved Sequence Features of Inteins (Protein Introns) and Their Use in Identifying New Inteins and Related Proteins" Aug. 10, 1994, Protein Science, vol. 3, pp. 2340-2350.
Pietrokovski, S. (1998) Modular organization of inteins and C-terminal autocatalytic domains. Protein Sci 7(1): 64-71.
Poirier, Yves, "Green Chemistry Yields a Better Plastic," Nature Biotechnology, vol. 17, Oct. 1999, pp. 960-961.
Riera et al., (1997) Ribonucleotide reductase in the archaeon Pyrococcus furiosus: a critical enzyme in the evolution of DNA genomes?. Proc Natl Acad Sci U S A 94(2): 475-8.
Rocha-Sosa, M., et al., "Both Developmental and Metabolic Signals Activate the Promoter of a Class I Patatin Gene," The EMBO Journal, vol. 8, No. 1, 1989, pp. 23-29.
Ruepp et al., (2000) The genome sequence of the thermoacidophilic scavenger Thermoplasma acidophilum. Nature. 407(6803): 508-13.
Saves et al., (2000) Inteins of Thermococcus fumicolans DNA polymerase are endonucleases with distinct enzymatic behaviors. J Biol Chem 275(4): 2335-41.
Saves et al., (2000C) The Thy pol-2 intein of Thermococcus hydrothermalis is an isoschizomer of PI-TliI and PI-TfuII endonucleases: Nucleic Acids Res 28(21): 4391-6.
Schreier, P.H., et al., The Use of Nuclear-Encoded Sequences to Direct the Light-Regulated Synthesis and Transport of a Foreign Protein into Plant Chloroplasts, The EMBO Journal, vol. 4, No. 1, 1985, pp. 25-32.
Senejani et al., (2001) The intein of the Thermoplasma A-ATPase A subunit: structure, evolution and expression in *E. coli*. BMC Biochem 2: 13.
Shao et al., (1995) Protein splicing: characterization of the aminosuccinimide residue at the carboxyl terminus of the excised intervening sequence. Biochemistry 34(34): 10844-50.
Shao et al., (1996) Protein splicing: evidence for an N-O acyl rearrangement as the initial step in the splicing process. Biochemistry 35(12): 3810-5.
Shen et al., (2001) Invariant Asp-1122 and Asp-1124 are essential residues for polymerization catalysis of family D DNA polymerase from Pyrococcus horikoshii. J Biol Chem 276(29): 27376-83.
Shimamoto, K., et al., Fertile Transgenic Rice Plants Regenerated from Transformed Protoplasts, Nature, vol. 338, Mar. 1989, pp. 274-276.
Shingledecker et al., "Reactivity of the Cysteine Residues in the Protein Splicing Active Center of the *Mycobacterium* Tuberculosis RecA intein" Mar. 1, 2000, Archives of biochemistry and biophysics, vol. 375, No. 1, pp. 138-144.

(56) References Cited

OTHER PUBLICATIONS

Sijmons, P.C., et al., Production of Correctly Processed Human Serum Albumin in Transgenic Plants, Biotechnology, vol. 8, Mar. 1990, pp. 217-221.

Smeekens, et al., "Protein Transport into and Within Chloroplasts," Trends in Biochemical Sciences, vol. 15, Feb. 1990, pp. 73-76.

Smith et al., (1997B) Complete genome sequence of Methanobacterium thermoautotrophicum deltaH: functional analysis and comparative genomics. J Bacteriol 179(22): 7135-55.

Southworth et al., (1998) Control of protein splicing by intein fragment reassembly. Embo J 17(4): 918-26.

Southworth et al., (1999) Purification of proteins fused to either the amino or carboxy terminus of the *Mycobacterium xenopi* gyrase A intein. Biotechniques 27(1): 110-4, 116, 118-20.

Southworth et al., (2000) An alternative protein splicing mechanism for inteins lacking an N-terminal nucleophile. Embo J 19(18): 5019-26.

Ng et al., (2000) Genome sequence of *Halobacterium* species NRC-1. Proc Natl Acad Sci U S A. 97(22): 12176-81.

Horsch, R.B., et al, "A Simple and General Method for Transferring Genes into Plants," Science, Mar. 1985, pp. 1229-1231.

Robert M. Horton et al., "Engineering hybrid genes without the use of restriction enzymes: gene splicing by overlap extension." Gene, vol. 77, 61-68, 1989.

Oliver Koetting et al., "Starch-EXCESS4 Is a Laforin-Like Phosphoglucan Phosphatase Required for Starch Degradation in Arabidopsis thaliana", The Plant Cell, vol. 21, 334-346, Jan. 2009.

Halil Kavakli et al., "Generation, characterization, and heterologous expression of wild-type and up-regulated forms of Arabidopsis thaliana leaf ADP-glucose pyrophosphorylase," Planta, vol. 215, 430-439; 2002.

Guo, Haiwei H. et al. "Protein tolerance to random amino acid change", PNAS vol. 101, No. 25, pp. 9205-9210 (Jun. 22, 2004).

GenBank Accession No. BAA33708, first available Oct. 8, 1999.

Streatfield, Stephen J. et al. "Corn as a production system for human and animal vaccines", Vaccine 21, pp. 812-815 (2003).

Tokuda, Gaku et al. "Metazoan cellulase genes from termites: intron/exon structures and sites of expression", Biochimica et Biophysica Acta 1447, pp. 146-159 (1999).

Christian, D.G. et al. "The yield and composition of switchgrass and coastal panic grass grown as a biofuel in Southern England" Bioresource Technology 83, pp. 115-124 (2002).

Sivamani, Elumalai et al. "Expression enhancement of a rice polyubiquitin gene promoter" Plant Molecular Biology 60, pp. 225-239 (2006).

Belknap, William R. et al. "pBINPLUS/ARS: an improved plant transformation vector based on pBINPLUS" BioTechniques vol. 44, No. 6, pp. 753-756 (May 2008).

Office Action in a related case, U.S. Appl. No. 13/508,280 dated Mar. 26, 2015 (24 pages).

Tokuda et al. Cellulose Digestion in the Wood-Eating Higher Termite Nasutitermes takasagoensis (Shiraki): Distribution of Cellulases and Properties of Endo-β-1,4-glucanases, Zoological Science 14: 83-93(1997).

Ukraine Office Action issued in corresponding application No. a201311637 with English translation.

U.S. Office Action issued in corresponding U.S. Appl. No. 13/793,078.

U.S. Office Action issued in U.S. Appl. No. 13/508,280.

* cited by examiner

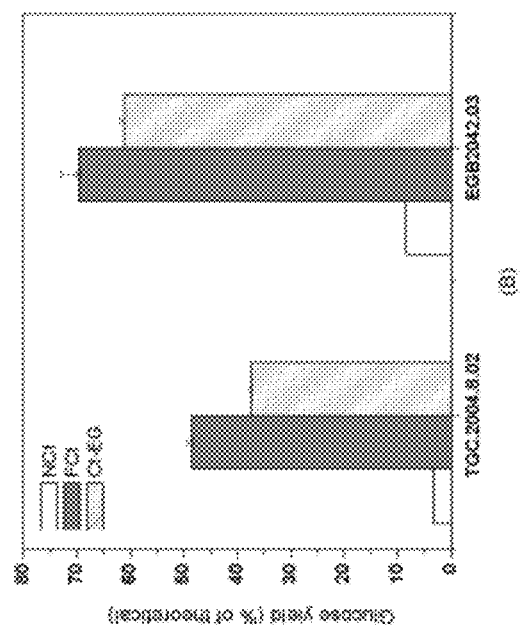
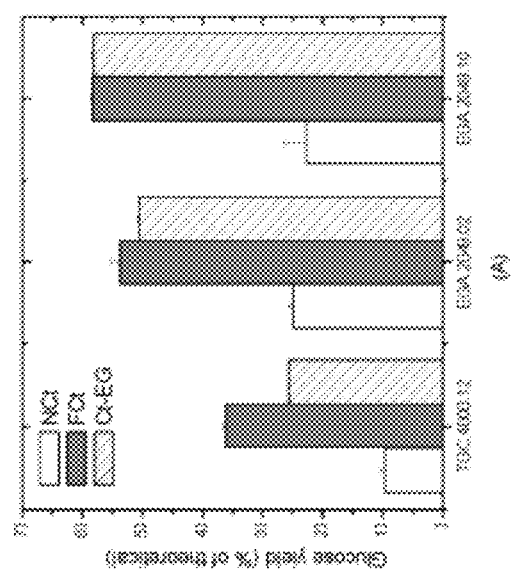
FIG. 4A
FIG. 4B

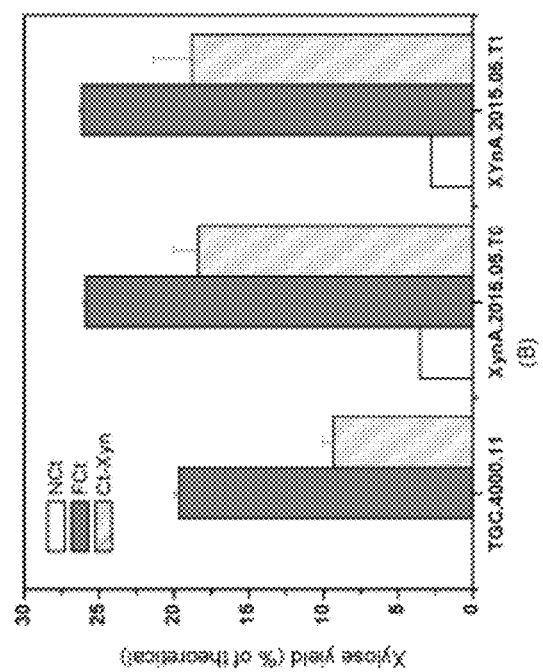
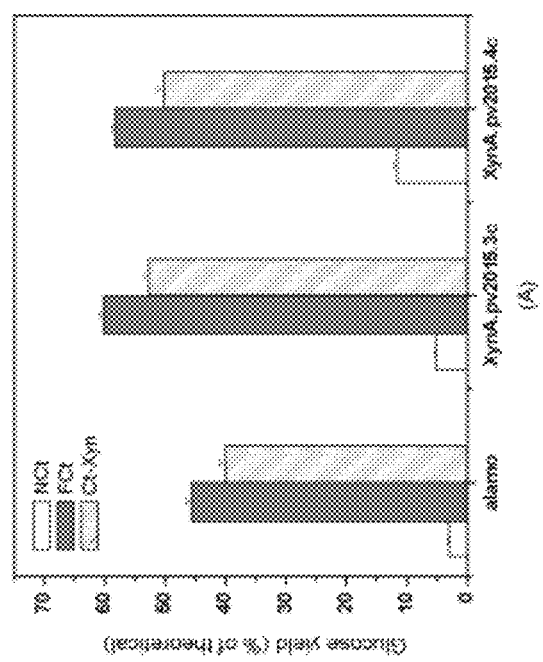
FIG. 7B
FIG. 7A

FIG.24A
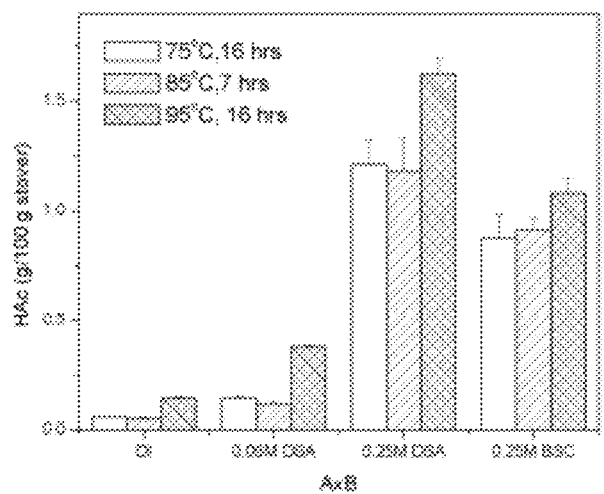
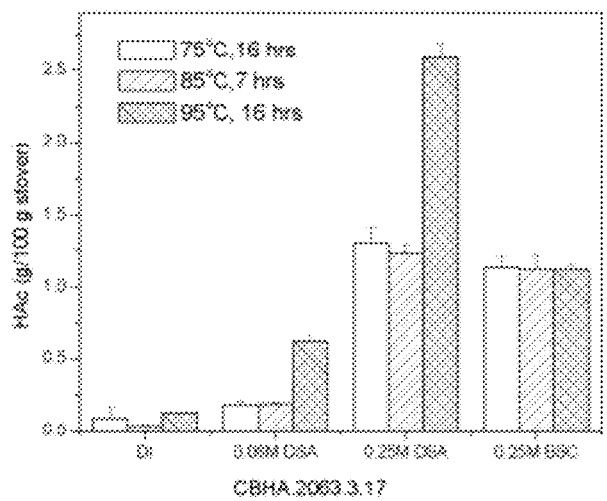
FIG. 24B

FIG. 25A
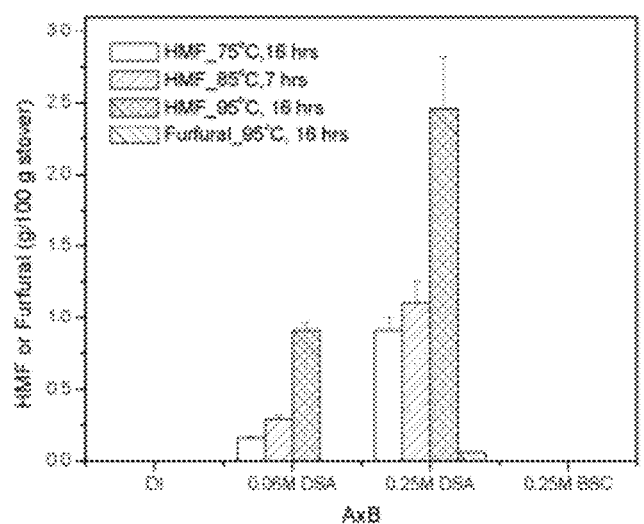
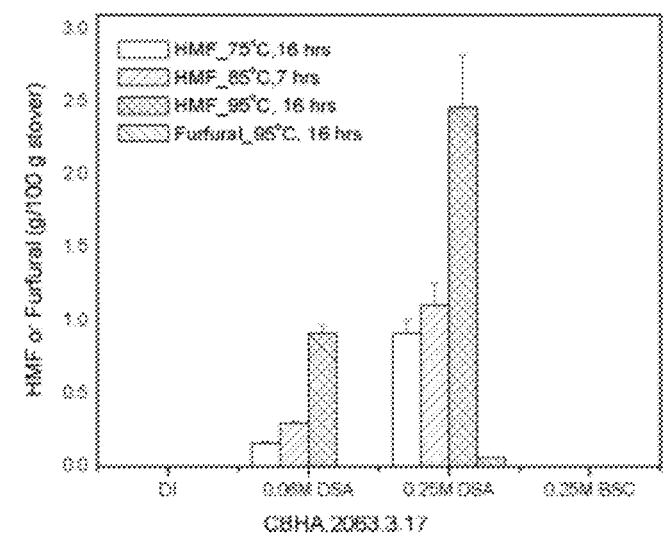
FIG. 25B

CONSOLIDATED PRETREATMENT AND HYDROLYSIS OF PLANT BIOMASS EXPRESSING CELL WALL DEGRADING ENZYMES

This application is a non-provisional of and claims the benefit of U.S. Provisional application 61/449,769, which was filed Mar. 7, 2011. This application is a continuation-in-part of U.S. patent application Ser. No. 12/590,444, which was filed Nov. 6, 2009 and issued on Apr. 16, 2013 as U.S. Pat. No. 8,420,387. This application is also a continuation-in-part of U.S. patent application Ser. No. 13/004,713, which was filed Jan. 11, 2011 and issued on Aug. 21, 2012 as U.S. Pat. No. 8,247,647. This application is also a continuation-in-part of International Patent Application Serial No. PCT/US10/55746, which was filed Nov. 5, 2010 and was a continuation-in-part of U.S. patent application Ser. No. 12/590,444, which was filed Nov. 6, 2009, and claimed the benefit of U.S. Provisional Application Ser. No. 61/280,635, filed Nov. 6, 2009, and U.S. Provisional Application Ser. No. 61/398,589, filed Jun. 28, 2010. This application is also a continuation-in-part of International Patent Application Serial No. PCT/US10/55669, which was filed Nov. 5, 2010, and was a continuation-in-part of U.S. patent application Ser. No. 12/590,444, filed Nov. 6, 2009. This application is also a continuation-in-part of International Patent Application Serial No. PCT/US10/55751, which was filed Nov. 5, 2010, and was a continuation-in-part of U.S. patent application Ser. No. 12/590,444. All of the foregoing are incorporated herein by reference as if fully set forth.

The Sequence listing filed with this application, titled "Sequence Listing," having a file size of 620,320 bytes, and created on Mar. 8, 2012 is incorporated herein by reference as if fully set forth. The Substitute Sequence listing titled "Substitute Sequence Listing" filed Jun. 22, 2012, having a file size of 616,422 bytes, and created Jun. 22, 2012 is incorporated herein by reference as if fully set forth.

GOVERNMENT SUPPORT STATEMENT

This invention was made at least in part with government support under the United States Department of Energy Advanced Research Projects Agency—Energy (ARPA-e) Grant No. DE-AR0000042. The Government has certain rights in this invention.

The sequence listing electronically filed with this application titled "Sequence Listing," created on Mar. 7, 2012, and having a file size of 620,320 bytes is incorporated herein by reference as if fully set forth.

FIELD OF INVENTION

The disclosure relates to methods for producing soluble sugars from plants expressing cell wall degrading enzymes, transgenic plants, expression vectors, nucleic acids, and cell wall degrading proteins.

BACKGROUND

Lignocelluosic biomass is an attractive feedstock for the production of biofuels, chemicals, and bioproducts. Lignocellulosic biomass provides many benefits, including abundant availability, potential low cost, sustainability, and the fact that it is not ordinarily consumed by humans as a source of food (Langeveld J W A et al. 2010 Crop Sci 50: S131-S151). To convert lignocellulosic biomass into renewable energy and biochemicals, bioprocesses convert a portion of the lignocellulosic biomass into simple sugars, which are converted into biofuels or other bioproducts.

The cost of sugar production through biological conversion is expensive due to the costs of biomass pretreatment and enzymatic hydrolysis (Alvira P et al. 2010 Bioresour Technol 101: 4851; Abramson M et al. 2010 Plant Science 178: 61; Daniel Klein-Marcuschamer et al. Biotechnol. Bioeng. 2012; 109:1083). Plant cell walls are recalcitrant to enzymatic hydrolysis because the heterogeneity, chemical composition and structural features of the cell wall polysaccharides make them inaccessible to hydrolytic enzymes (Zhu L et al. 2008 Bioresour Technol 99: 3817). For this reason, enzymatic hydrolysis requires a pretreatment that can make plant cell walls accessible. The pretreatment technologies prevalent in industry typically employ harsh conditions such as high temperatures and extreme pHs (Wyman C E et al. 2005 Bioresour Technol 96:1959; Mosier N et al. 2005 Bioresour Technol 96: 673). These conditions cause sugar degradation and result in reduced sugar yields and formation of toxic fermentation compounds, requiring expensive additional steps for detoxification, separation and neutralization as well as expensive up-front capital equipment.

Pretreatment costs, high costs of exogenous enzyme loadings, slow hydrolysis rate, and limited supply of enzymes are also concerns for the commercialization of processes involving lignocellulosic biomass.

SUMMARY

In an aspect, the invention relates to a method for producing soluble sugars from engineered plant material. The method includes pretreating by mixing the engineered plant material with a pulping formulation to form a mixture. The engineered plant material includes a first polynucleotide sequence encoding a first protein selected from the group consisting of: a xylanase, an endoglucanase, an exoglucanase, a feruloyl esterase, an intein-modified xylanase, an intein-modified endoglucanase, an intein-modified exoglucanase, and an intein-modified feruloyl esterase. The method also includes providing hydrolysis conditions.

In an aspect, the invention relates to an engineered plant. The engineered plant includes a first polynucleotide sequence encoding an amino acid sequence with at least 90% identity to a first reference sequence selected from the group consisting of: SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, and SEQ ID NO: 11.

In an aspect, the invention relates to an expression cassette. The expression cassette includes a first polynucleotide sequence capable of hybridizing under conditions of moderate stringency to a nucleic acid consisting of a first reference sequence selected from the group consisting of: SEQ ID NO: 32, SEQ ID NO: 33, SEQ ID NO: 34, SEQ ID NO: 35, SEQ ID NO: 36, SEQ ID NO: 37, SEQ ID NO: 38, and SEQ ID NO: 39 [P77853:S158-30-108-35]. The expression cassette also includes a second polynucleotide sequence capable of hybridizing under conditions of moderate stringency to a nucleic acid consisting of a second reference sequence selected from the group consisting of: SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, and SEQ ID: 43. The SEQ ID NO selected as the first reference sequence is different than the SEQ ID NO selected as the second reference sequence.

In an aspect, the invention relates to an expression cassette. The expression cassette includes a polynucleotide sequence capable of hybridizing under conditions of moderate stringency to a nucleic acid consisting of a reference sequence selected from the group of sequences consisting of: SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, and SEQ ID NO: 62.

In an aspect, the invention relates to an expression vector. The expression vector includes a polynucleotide sequence capable of hybridizing under conditions of moderate stringency to nucleic acid consisting of a sequence selected from the group consisting of: SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, and SEQ ID NO: 83.

BRIEF DESCRIPTION OF THE DRAWINGS

The following detailed description of the preferred embodiments of the present invention will be better understood when read in conjunction with the appended drawings. For the purpose of illustrating the invention, there are shown in the drawings embodiments which are presently preferred. It is understood, however, that the invention is not limited to the precise arrangements and instrumentalities shown. In the drawings:

FIG. 4 illustrates glucose yields from pretreated transgenic plants expressing endoglucanase (EG) following enzymatic hydrolysis with enzyme cocktail #1 (FCt; gray (middle)), or the enzymatic cocktail #1 lacking endoglucanase (Ct-EG (right)), or no enzymes (NCt; white (left)). FIG. 4A illustrates glucose yield from transgenic plants expressing endoglucanase A (EGA.2049.02 and EGA.2049.10) and a transgenic control plant lacking endoglucanase (TGC.4000.12). FIG. 4B illustrates glucose yield from a transgenic plant expressing endoglucanase B (EGB2042.03) and a transgenic control plant lacking endoglucanase (TGC.2004.8.02).

FIGS. 5A and 5C illustrate glucose yields, and FIGS. 5B and 5D illustrate xylose yields from test transgenic plants and the transgenic control plants with cocktail #1. FIGS. 5A and 5B illustrate results with 1) double stack transgenic plants XynA/AccA/B.2096.05 and XynA/AccA/B.2096.01, which express xylanase A (XynA) and accessory enzymes (Acc) and 2) a transgenic control plant TGC.2004.8.02 in treatments with a full enzyme cocktail (FCt; dark gray (middle)), a full cocktail lacking xylanase (FCt-Xyn; striped bars (right)) and no enzymes (NCt; white bars (left)). FIGS. 5C and 5D illustrate results with 1) a transgenic plant EGA/XynA.2242.09 expressing XynA and EGA and 2) a transgenic control plant TGC.4000.12 in treatments with a full enzyme cocktail (FCt; dark gray (left bar of the four for each sample)), a full cocktail lacking xylanase (Ct-Xyn; diagonal stripes (second from left)), a full cocktail lacking endoglucanase (Ct-EG; white (third from left)) and a full cocktail lacking xylanase and endoglucanase (Ct-Xyn-EG; checked (fourth from left)).

FIGS. 7A-7B illustrate glucose and xylose yields, respectively, from transgenic plants. FIG. 7A shows glucose yields from pretreated transgenic switchgrass plants expressing xylanase A (XynA.pv2015.3c, XynA.pv2015.4c) and a pretreated wild-type switchgrass plant (Alamo) following enzymatic hydrolysis with the enzyme cocktail #1 (FCt; gray (middle)); the cocktail #1 lacking xylanase (Ct-Xyn; diagonal stripes (right)); and a control treatment lacking the enzyme cocktail (NCt; white (left)). FIG. 7B shows the xylose yield results from a pretreated first generation transgenic plant expressing xylanase A (XynA.2015.05.T0), a second generation transgenic plant expressing xylanase A (XynA.2015.05.T1) and a pretreated transgenic plant lacking xylanase (TGC.4000.11) following enzymatic hydrolysis with the enzyme cocktail #1 (FCt; gray (middle)); the cocktail #1 lacking xylanase (Ct-Xyn; diagonal stripes (right)); and a control treatment lacking the enzyme cocktail (NCt; white (left)).

FIGS. 24A-24B illustrate yield of acetic acid (HAc) from a non-transgenic control plant (A×B; FIG. 24A) and a transgenic plant expressing exoglucanase CBHA (CBHA.2063.3.17; FIG. 24B). The treatments were performed at 75° C. for 16 hours (white (left)); 85° C. for 7 hours (striped bars (middle)) and 95° C. (checked (right)).

FIGS. 25A-25B illustrate yield of sugar degradation products hydroxymethylfurfural (HMF) and furfural from a non-transgenic control plant (A×B; FIG. 25A) and a transgenic plant expressing exoglucanase CBHA (CBHA.2063.3.17). The treatments as indicated by white, striped or checked bars were as follows from left to right: white, HMF_75° C. for 16 hours; striped, HMF_85° C. for 7 hours; checked, HMF_95° C. for 16 hours; striped, Furfural_95° C. for 16 hours).

DETAILED DESCRIPTION OF THE PREFERRED EMBODIMENTS

Figure 1:
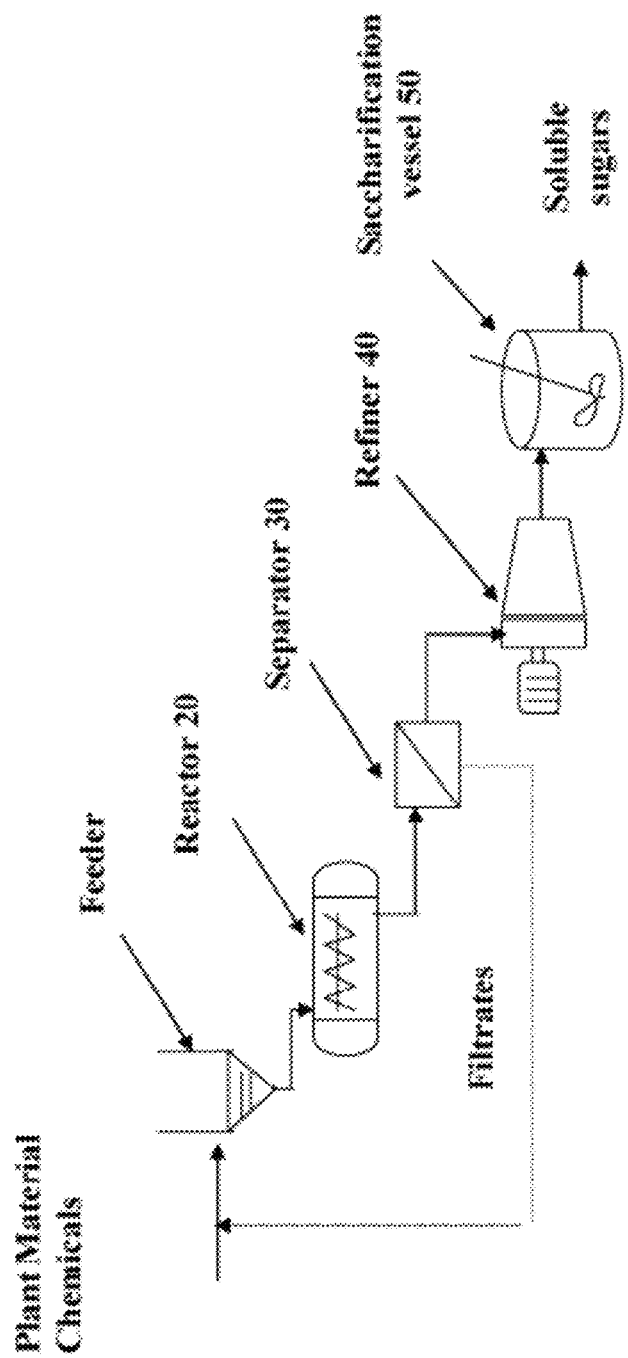
FIG. 1 is a process flow diagram illustrating steps of consolidated pretreatment and hydrolysis of plant biomass expressing cell wall degrading enzymes.

Certain terminology is used in the following description for convenience only and is not limiting. The words "right," "left," "top," and "bottom" designate directions in the drawings to which reference is made. The words "a" and "one," as used in the claims and in the corresponding portions of the specification, are defined as including one or more of the referenced item unless specifically stated otherwise. This terminology includes the words above specifically mentioned, derivatives thereof, and words of similar import. The phrase "at least one" followed by a list of two or more items, such as "A, B, or C," means any individual one of A, B or C as well as any combination thereof.

Embodiments herein provide technologies to express a portfolio of cell wall degrading (CWD) proteins in a plant. The CWD proteins may be CWD enzymes or modified forms of the CWD enzymes. The modified forms may be intein modified CWD proteins. The plant may be maize, sorghum, switchgrass, or another plant. Embodiments herein provide for harvesting plant biomass with in planta CWD proteins for use as a feedstock in sugar production. In planta enzyme expression uses the plant as a "factory" rather than microbial fermentation to produce industrial CWD enzymes. This strategy has an advantage of delivering the proteins directly in the biomass feedstocks for fermentable sugar production. Transgenic plant biomass with hydrolytic traits may not require harsh pretreatments to improve cellulose cell wall accessibility to exogenous enzymes. The expression of different classes of CWD proteins in a single plant may create a low cost sugar platform for biofuel and biochemical production. Embodiments herein provide methods for producing soluble sugars using a mild chemical pretreatment of lignocellulosic biomass derived from plants genetically engineered to include one or more types of a CWD protein.

An embodiment provides a method for producing soluble sugars from engineered plant material. The method may include pretreating the engineered plant material through mixing with a pulping formulation to form a mixture. The engineered plant material may include a first polynucleotide sequence encoding a first protein. The first protein may be a CWD enzyme. The first protein may be an intein-modified CWD enzyme. The first protein may be a xylanase, an endoglucanase, an exoglucanase, a feruloyl esterase, an intein-modified xylanase, an intein-modified endoglucanase, an intein-modified exoglucanase, or an intein-modified feruloyl esterase. The first protein may be capable of hydrolyzing a component of the engineered plant material. Being capable of hydrolyzing a component means that the first protein catalyzes hydrolysis of the component under hydrolysis conditions. In the case of an intein modified first protein, being capable of hydrolyzing a component means that after the intein has spliced from the peptide, the protein may hydrolyze the component under hydrolysis conditions. The method may further include providing hydrolysis conditions. The hydrolysis conditions may be suitable for hydrolyzing the component.

The engineered plant material may further include a second polynucleotide sequence encoding a second protein. The second protein may be a CWD protein. The second protein maybe an intein-modified CWD protein. The second protein may be a xylanase, an endoglucanase, an exoglucanase, a feruloyl esterase, an intein-modified xylanase, an intein-modified endoglucanase, an intein-modified exoglucanase, or an intein-modified feruloyl esterase. The protein selected as the second protein may be different than the protein selected as the first protein. The second protein may be capable of hydrolyzing a component of the engineered plant material. Being capable of hydrolyzing a component means that the second protein catalyzes hydrolysis of the component under hydrolysis conditions. In the case of an intein modified second protein, being capable of hydrolyzing a component means that after the intein has spliced from the peptide, the protein may hydrolyze the component under hydrolysis conditions.

The engineered plant material may further include a third polynucleotide sequence encoding a third protein. The third protein may be a CWD protein. The third protein maybe an intein-modified CWD protein. The third protein may be a xylanase, an endoglucanase, an exoglucanase, a feruloyl esterase, an intein-modified xylanase, an intein-modified endoglucanase, an intein-modified exoglucanase, or an intein-modified feruloyl esterase. The protein selected as the third protein may be different than the protein selected as the first protein. The protein selected as the third protein may be different than the protein selected as the second protein. The third protein may be capable of hydrolyzing a component of the engineered plant material. Being capable of hydrolyzing a component means that the third protein catalyzes hydrolysis of the component under hydrolysis conditions. In the case of an intein modified third protein, being capable of hydrolyzing a component means that after the intein has spliced from the peptide, the protein may hydrolyze the component under hydrolysis conditions.

Engineered plant material refers to a transgenic plant, progeny of a transgenic plant, a descendant of a transgenic plant, or a part of any of the foregoing. Engineered plant material may include a cell wall degrading enzyme, which does not occur naturally in the plant, or a gene encoding the same. Engineered plant material may be a transgenic plant expressing a CWD protein, or any part of the transgenic plant. Engineered plant material may be any transgenic plant expressing a modified form of a CWD protein, or any part of the transgenic plant. The transgenic plant may be of any type of plant. The transgenic plant type of plant may be but is not limited to maize, sugar beet, sugar cane, sorghum, switchgrass, miscanthus, eucalyptus, willow, or poplar. Engineered plant material may be a whole transgenic plant or parts of the plant. The parts may be but are not limited to leaves, stems, flowers, buds, petals, ovaries, fruits, or seeds. Engineered plant material may be callus from a transgenic plant. Engineered plant material may be regenerated from parts of a transgenic plant or plants. Engineered plant material may be a product of sexual crossing of a first transgenic plant and a second transgenic plant or a non-transgenic plant where the product plant retains a polynucleotide sequence introduced to the first transgenic plant. The transgenic plant may be any one of the transgenic plants provided herein. The transgenic plant may include any vector, expression cassette, or isolated nucleic acid or fragment thereof herein.

Mixing of engineered plant material with a pulping formulation may be done by any combination of the engineered plant mater with the pulping formulation. Mixing may be done by agitation.

The pulping formulation may be a substance that breaks down lignin, which binds the lignocellulose fibers within lignocellulosic plant material together. The substance may break down ligin without seriously degrading the lignocellulose fibers. Pretreating may lead to a partial release of enzymes expressed in the genetically engineered plants and partial degradation of lignin within lignocellulosic plant material.

The method may include activation of a CWD protein before, during or after pretreating. The method may include activation of a CWD protein before, during or after providing hydrolysis conditions. The CWD protein being activated may be a first protein, second protein, or third protein, or any additional lignocellulose processing enzyme. A CWD protein may be modified to include an intein. The intein may be fused to the CWD enzyme on an end of the enzyme or within the enzyme. The intein may be inducible to splice by providing induction conditions. The induction conditions may be a particular temperature of the mixture. The induction conditions may be a temperature provided before, during, or after one of the pretreating or providing hydrolysis steps. Intein modified enzymes and conditions for inducing splicing of the inteins, which could be used as activation conditions, were described in U.S. application Ser. No. 10/886,393 filed Jul. 7, 2004 and PCT/US10/55746 filed Nov. 5, 2010, and PCT/US10/55669 filed Nov. 5, 2010 and PCT/US10/55751 filed Nov. 5, 2010, which are incorporated herein by reference as if fully set forth.

The component may be any moiety desired for processing. The component may be lignocellulosic material. The component may be the substrate for any CWD protein listed herein. The component may be the substrate for a xylanase, an endoglucanase, an exoglucanase, a feruloyl esterase. The component may be a moiety including a substrate for any CWD protein listed herein. The component may be a moiety including a substrate for a xylanase, an endoglucanase, an exoglucanase, a feruloyl esterase.

The method may also include adding other plant material before, during, or after mixing, pretreating, or providing hydrolysis conditions. Other plant material may be any plant biomass, cellulosic or lignocellulosic material other than the engineered plant material. The other plant material may be from biorefineries. Other plant material may include forestry and agricultural residues. The forestry and agricultural residues may be, but are not limited to, corn stover, baggasses, wheat straw, waste wood, forest trimmings, waste paper, and municipal solid wastes (MSW). Other plant material may be any energy crop. The energy crop may be, but is not limited to, switchgrass, sorghum, sugar beet, sugar cane, miscanthus and poplar.

A polynucleotide sequence encoding a first protein, a second protein, a third protein, or any additional enzyme may be operably connected to a regulatory sequence. In this context, operably connected means that the regulatory element imparts it function to the polynucleotide sequence. In the case of a regulatory element that is a promoter, the promoter is capable of controlling expression from the polynucleotide sequence when they are operably connected. In the case of a regulatory element that is a terminator, the terminator is capable of terminating transcription from the polynucleotide sequence. Non-limiting examples of regulatory elements are provided below.

At least one of the first protein, the second protein, or the third protein may be but is not limited to an enzyme selected from XynA: Beta-1,4-xylanase 229B from *Dictyoglomus thermophilum* (Uniprot accession P77853); XynB: Endo-1,4-beta-xylanase from *Thermomyces lanuginosus* (Uniprot accession O43097); EGA: Endo-beta 1,4-endoglucanase from *Nasutitermes takasagoensis* (Uniprot accession O77044); EGB: Endo-beta 1,4-endoglucanase from *Acidothermus cellulolyticus* (Uniprot accession P54583); AccA: Feruloyl esterase A from *Aspergillus niger* (Uniprot accession O42807); AccB: Feruloyl esterase B from *Aspergillus niger* (Uniprot accession number Q8WZI8); AccA/B: Feruloyl esterase A and Feruloyl esterase B from *Aspergillus niger*; EGC: Endo-beta 1,4-endoglucanase from *Rhodothermus marinus* (Uniprot accession O33897); P40942: Beta-1,4-xylanase from *Clostridium stercorarium* F9 (Uniprot accession number P40942); P40943: Beta-1,4-xylanase from *Geobacillus stearothermophilus* T-6 (*Bacillus stearothermophilus*; Uniprot accession number P40943); O30700: Beta-1,4-xylanase from *Bacillus* sp. NG-27 (Uniprot accession number O30700); CBHA: cellobiohydrolase A from *Clostridium thermocellum* (Uniprot accession number O68438); CBHB: cellobiohydrolase B (SYT BD22308); or XynE: xylanase (EU591743).

The first protein may include, consist essentially of, or consist of an amino acid sequence with at least 70, 72, 75, 80, 85, 90, 91, 92, 93, 94, 95, 96, 97, 98, 99, or 100% identity to a reference sequence selected from the group consisting of: SEQ ID NO: 1 [WT P77853], SEQ ID NO: 2 [AnfaeA], SEQ ID NO: 3 [AnfaeB], SEQ ID NO: 4 [NtEGm], SEQ ID NO: 5 [EU591743], SEQ ID NO: 6 [O43097], SEQ ID NO: 7 [P77853:T134-100-101], SEQ ID NO: 8 [P77853:S158-30-108-35], SEQ ID NO: 9 [O33897], SEQ ID NO: 10 [O68438], and SEQ ID NO: 11 [P54583]. The first protein may include, consist essentially of, or consist of an amino acid sequence with at least 70, 72, 75, 80, 85, 90, 91, 92, 93, 94, 95, 96, 97, 98, 99, or 100% identity to the reference sequence of SEQ ID: 12 [BD22308].

The second protein may include, or consist essentially of, or consist of an amino acid sequence with at least 70, 72, 75, 80, 85, 90, 91, 92, 93, 94, 95, 96, 97, 98, 99, or 100% identity to a second reference sequence selected from the group consisting of: SEQ ID NO: 1 [WT P77853], SEQ ID NO: 2 [AnfaeA], SEQ ID NO: 3 [AnfaeB], SEQ ID NO: 4 [NtEGm], SEQ ID NO: 5 [EU591743], SEQ ID NO: 6 [O43097], SEQ ID NO: 7 [P77853:T134-100-101], SEQ ID NO: 8 [P77853:S158-30-108-35], SEQ ID NO: 9 [O33897], SEQ ID NO: 10 [O68438], and SEQ ID NO: 11 [P54583]. The second protein may include, consist essentially of, or consist of an amino acid sequence with at least 70, 72, 75, 80, 85, 90, 91, 92, 93, 94, 95, 96, 97, 98, 99, or 100% identity to the reference sequence of SEQ ID: 12 [BD22308].

The third protein may include, consist essentially of, or consist of an amino acid sequence with at least 70, 72, 75, 80, 85, 90, 91, 92, 93, 94, 95, 96, 97, 98, 99, or 100% identity to a third reference sequence selected from the group consisting of SEQ ID NO: 1 [WT P77853], SEQ ID NO: 2 [AnfaeA], SEQ ID NO: 3 [AnfaeB], SEQ ID NO: 4 [NtEGm], SEQ ID NO: 5 [EU591743], SEQ ID NO: 6 [O43097], SEQ ID NO: 7 [P77853:T134-100-101], SEQ ID NO: 8 [P77853:S158-30-108-35], SEQ ID NO: 9 [O33897], SEQ ID NO: 10 [O68438], and SEQ ID NO: 11 [P54583]. The third protein may include, consist essentially of, or consist of an amino acid sequence with at least 70, 72, 75, 80, 85, 90, 91, 92, 93, 94, 95, 96, 97, 98, 99, or 100% identity to the reference sequence of SEQ ID: 12 [BD22308].

At least one of the first polynucleotide sequence, the second polynucleotide sequence, or the third polynucleotide sequence may further include a first targeting polynucleotide sequence encoding a respective targeting peptide. For engineered plant material lacking the third polynucleotide sequence, a first targeting polynucleotide sequence may be included on at least one of the first polynucleotides sequence or the second polynucleotide sequence. For engineered plant material lacking the second polynucleotide sequence and the third polynucleotide sequence, a first targeting polynucleotide sequence may be included on the first polynucleotide sequence. Each respective targeting peptide may be independently selected for each of the first, the second, or the third polynucleotide sequence. A targeting peptide may be fused to the first protein, the second protein, or the third protein. Each respective targeting peptide may be independently selected from but is not limited to an amyloplast targeting signal, a cell wall targeting peptide, a mitochondrial targeting peptide, a cytosol localization signal, a chloroplast targeting signal, a nuclear targeting peptide, and a vacuole targeting peptide.

A first targeting polynucleotide may be upstream of the first polynucleotide sequence, the second polynucleotide sequence or the third polynucleotide sequence. A targeting peptide may have at least 70, 72, 75, 80, 85, 90, 91, 92, 93, 94, 95, 96, 97, 98, 99, or 100% identity to one of SEQ ID NO: 13 [BAASS], the barley aleurone sequence SEQ ID NO: 14 [HVAlePS], SEQ ID NO: 15 [PR1a], SEQ ID NO: 16 [the gamma-zein sequence xGZein27ss-02], or SEQ ID NO: 17 [Glu B4SP].

A first targeting polynucleotide sequence in combination with one of the first polynucleotide sequence, the second polynucleotide sequence, or the third polynucleotide sequence together may encode an amino acid sequence with at least 70, 72, 75, 80, 85, 90, 91, 92, 93, 94, 95, 96, 97, 98, 99, or 100% identity to a reference sequence selected from the group consisting of: SEQ ID NO: 18 [BAASS:P77853], SEQ ID NO: 19 [BAASS:033897], SEQ ID NO: 20 [HVAlePS:NtEGm], and SEQ ID NO: 21 [BAAS:P77853:S158-30-108-35].

At least one of the first polynucleotide sequence, the second polynucleotide sequence, or the third polynucleotide sequence may further include a second targeting polynucleotide sequence encoding a carboxy targeting peptide. For engineered plant material lacking the third polynucleotide sequence, a second targeting polynucleotide sequence may be included on at least one of the first polynucleotide sequence or the second polynucleotide sequence. For engineered plant material lacking the second polynucleotide sequence and the third polynucleotide sequence, a second targeting polynucleotide sequence may be included on the first polynucleotide sequence. A carboxy targeting peptide may be selected from but is not limited to sequence having at least 70, 72, 75, 80, 85, 90, 91, 92, 93, 94, 95, 96, 97, 98, 99, or 100 identity to one of SEQ ID NO: 22 [SEKDEL], the abridged SEQ ID NO: 23 [KDEL], or the barley vacuolar sorting determinant sequence SEQ ID NO: 24 [HvVSD-01]. A carboxy targeting peptide may be fused to at least one of the first protein, the second protein, or the third protein.

At least one of the first protein, the second protein, or the third protein may be provided without the targeting peptide for accumulation in cytoplasm.

The first targeting polynucleotide sequence and the second targeting polynucleotide sequence in combination with one of the first polynucleotide sequence, the second polynucleotide sequence, or the third polynucleotide sequence together may encode an amino acid sequence with at least 70, 72, 75, 80, 85, 90, 91, 92, 93, 94, 95, 96, 97, 98, 99, or 100% identity to a reference sequence selected from the group consisting of: SEQ ID NO: 25 [BAASS: AnfaeB: SEKDEL], SEQ ID NO: 26 [BAASS:AnfaeA:SEKDEL], SEQ ID NO: 27 [PR1a: NtEGm:SEKDEL], SEQ ID NO: 28 [BAASS: P77853:T134-100-101:SEKDEL], SEQ ID NO: 29 [HvAleSP:NtEGm: SEKDEL], SEQ ID NO: 30 [BAASS:O43097:SEKDEL] and SEQ ID NO: 31 [xGZein27ss-02:BD22308:HVVSD-01].

At least one of the first, the second or the third polynucleotide sequence may encode a "variant" of a CWD protein. The amino acid sequence of a variant of a CWD protein may differ by deletions, additions, substitutions of amino acid sequences, or other modifications of the CWD protein. A variant of a CWD protein may maintain the biological activity of the CWD protein. To maintain biological activity as used herein means that the variant has at least 60% of the activity of the CWD protein from which it is derived Activity of a xylanase may be assessed in an assay using Xylazyme AX substrate as described herein in the sub-section of Example 1 herein entitled "Stover Enzyme Assay." Activity of a endoglucanase may be assessed by using Cellazyme substrate as described herein in the sub-section of Example 1 herein entitled "Stover Enzyme Assay." Activity of a exoglucanase may be assessed by using fluorescent 4-methylumbelliferyl-b-D-lactopyranoside (4-MU) as described in Harrison M D et al. 2011 "Accumulation of recombinant cellobiohydrolase and endoglucanase in the leaves of mature transgenic sugar cane," Plant Biotechnology Journal 9: 884-896 and incorporated here by reference as if fully set forth. Activity of a feruloyl esterase may be assessed using an assay using pNP labeled ferulate as a substrate (as described in Hegde S. et al. 2009 "Single-step synthesis of 4-nitrophenyl ferulate for spectrophotometric assay of feruloyl esterases," Analytical Biochemistry 387(1): 128-129). The foregoing tests for activity of a xylanase, endoglucanase, exoglucanase, or feruloyl esterase may be utilized to determine whether a sequence with less than 100% identity to a CWD degrading protein sequence herein is a variant of the CWD degrading protein. Variants of a CWD protein herein may be modified in amino acid sequence versus the CWD protein based on similarity in hydrophobicity, hydrophilicity, solubility, polarity of amino acid residues. Variants of a CWD protein herein may differ following post-translational modifications. The differing post-translational modification may be but are not limited to glycosylations, acetylations, or phosphorylations. A variant may be developed by any means. A variant may be developed through site-directed mutagenesis or non-targeted mutagenesis. Error-prone PCR may be used to create mutants of a CWD protein herein, and any of the assays above may be used to assess whether the mutant is a variant.

Embodiments include at least one of the first protein, the second protein, or the third protein, or variants thereof, fused to variants of at least one of a targeting peptide, or a carboxy targeting peptide. Variants of a targeting peptide or a carboxy targeting peptide will target the protein it is fused with to the same location as the reference sequence for the targeting peptide or carboxy targeting peptide.

Variants of intein may be provided in a first protein, a second protein, or a third protein. An intein variant may splice from the protein in which it is fused.

For determining percent identity of two amino acid sequences or two nucleic acid sequence may include aligning and comparing the amino acid residues or nucleotides at corresponding positions in the two sequences. If all positions in two sequences are occupied by identical amino acid residues or nucleotides then the sequences are said to be 100% identical. Percent identity may be measured by the Smith Waterman algorithm (Smith T F, Waterman M S 1981 "Identification of Common Molecular Subsequences," J Mol Biol 147: 195-197, which is incorporated herein by reference as if fully set forth).

In an embodiment, a polynucleotide sequence that encodes a protein having less than 100% identity to the cited amino acid reference sequence may encode a variant of the protein having the amino acid reference sequence. In an embodiment, a protein having less than 100% identity to the cited amino acid reference sequence may be a variant of the protein having the amino acid reference sequence. In an embodiment, a polynucleotide sequence that encodes a protein having less than 100% identity to the protein encoded by the cited nucleic acid reference sequence may encode a variant of the protein encoded by the reference sequence.

Referring to FIG. 1, a method for producing soluble sugars from engineered plant material is illustrated. FIG. 1 depicts a process flow for consolidated pretreatment and hydrolysis of engineered plant material. Engineered plant material or engineered plant material admixed with other plant material may be added through Feeder 10 to Reactor 20 for chemical pretreatment and enzymatic liquefaction; i.e., the process of conversion of solid lignocellulosic biomass into a liquefied state suitable for further processing and hydrolysis. In Reactor 20, engineered plant material or engineered plant material admixed with other plant material may be mixed with the pulping formulation. The pulping formulation may include at least one moiety having an ion selected from the group consisting of: sulfite, bisulfite, sulfate, carbonate, hydroxide, and oxide. The at least one moiety further may include but is not limited to a counter ion selected from the group consisting of: ammonium, sodium, magnesium, and calcium. The at least one moiety may be a salt. A salt may be but is not limited to a sulfite ($SO_3^{2-}$), a bisulfite ($HSO_3^-$), an oxide ($O^{2-}$) and a hydroxide ($OH^-$). The salt may include a counter ion. A counter ion may be but is not limited to sodium ($Na^+$), calcium ($Ca^{2+}$), hydrogen, potassium ($K^+$), magnesium ($Mg^{2+}$), and ammonium ($NH_4^+$). A pulping formulation may include at least one of calcium oxide (CaO), lime, or calcium hydroxide ($Ca(OH)_2$), shaked lime.

In an embodiment, a pulping formulation may include at least one of ammonium bisulfite and ammonium carbonate. The ammonium bisulfite may be at a concentration of 0.02 M to 0.35 M and the ammonium carbonate may be at a concentration of 0.025 M to 0.25 M. The pulping formulation may be mixed with the engineered plant material or engineered plant material admixed with other plant material at an optimal liquid-to-solid ratio in a mixture. The mixture may have a liquid to solid ratio selected from the value of less than or equal to one of 10, 9, 8, 7, 6, 5, 4, 3, 2, or 1, or any value in a range between any two of the foregoing (endpoints inclusive). For example, the liquid to solid ratio may be a value less than any integer or non-integer number selected from 3 to 7. The liquid-to-solid ratio may be equal to 10, 9, 8, 7, 6, 5, 4, 3, 2, or 1, or any value in a range between any to of the foregoing (endpoints inclusive). For example, the liquid to solid ratio may be a value equal to any integer or non-integer number in the range from 3 to 7.

Pretreating may include incubating the mixture for any period of time. Pretreating may include incubating the mixture for up to 16 hours. Incubating may occur for longer or shorter periods may be performed. Pretreating may include incubating the mixture for a period of less or equal to one of 16, 15, 14, 13, 12, 11, 10, 9, 8, 7, 6, 5, 4, 3, 2, or 1 hour(s).

Pretreating may include providing a mixture temperature of 40° C. to 95° C. A mixture temperature of 40° C. to 95° C. may allow breakage or removal of portions of lignin within the lignocellulosic material in the mixture without deactivating hydrolytic enzymes. Pretreating may include providing a mixture temperature of 55° C., 65° C., 75° C., 95° C., less than 55° C., less than 65° C., less than 75° C., less than 95° C., less than 100° C., 40° C. to 55° C., 40° C. to 65° C., 40° C. to 75° C., 40° C. to 95° C., 40° C. to less than 100° C., 55° C. to 65° C., 55° C. to 75° C., 55° C. to 95° C., 55° C. to less than 100° C., 65° C. to 75° C., 65° C. to 95° C., 65° C. to less than 100° C., 75° C. to 95° C., 75° C. to less than 100° C., or 95° C. to less than 100° C.

Pretreating may include providing a mixture pH ranging from 5.0 to 10. Pretreating may include providing a mixture pH within a range of 6.5 to 8.5. The mixture pH provided may be 5.0, 5.5, 6.0, 7.0, 7.5, 8.0, 9.0, 9.5, or 10, or a pH within a range between any two of the foregoing pH values (endpoints inclusive). The pH of the mixture during pretreating may depend on the type of chemical used and/or type of plant material used. Providing a mixture pH may include adding a pH modifying chemical. A pH modifying chemical may be an acid or an alkali.

At the end of the pretreating step, the mixture may include partially degraded plant material and a liquid phase called a partial filtrate that may include chemicals from the pulping formulation and a low concentration of CWD enzyme or enzymes released from engineered plant material. The method may include separating the partial filtrate from solids of partially degraded plant material in Separator 30. Separation may be achieved through various processes. Separation may be achieved through sedimenting, filtering, or centrifuging the partial filtrate. The method may include at least one of collecting or recycling at least a portion of the partial filtrate in multiple rounds of pretreating. After removal of the partial filtrate, the concentration of solids within the mixture may be increased and may be any integer or non-integer value within a range of 2% to 15% (w/v), or any range within two integer values within the range of 2% to 15% (w/v).

The method may include washing the pretreated engineered plant material with any suitable liquid. The liquid may be deionized water. The liquid may be removed by centrifugation.

The method may further include refining by mechanical grinding, which is performed in Refiner 40 by any known method, such as, but is not limited to, defibrillation, milling, or crashing.

The method may include transferring refined pretreated biomass to Saccharification vessel 50. Hydrolysis by a CWD enzyme released from engineered plant material may occur in Saccharification vessel 5.

Providing hydrolysis conditions may include adjusting the mixture to 2% to 25% solids, to any integer or non-integer value within 2% to 25% solids (endpoints inclusive), or to any integer or non-integer value within a range between any two integers within 2% to 25% solids. Providing hydrolysis conditions may include incubating the mixture for a period of time up to 144 hours, a period of time selected from any one integer or non-integer value up to 144 hours, or a period of time within a range between any two integer values greater than zero and up to 144 hours. Providing hydrolysis conditions may include providing a mixture temperature of 100° C. or less, 65° C. or less, 50° C. or less, 48° C. to 50° C., 48° C. to 65° C., 48° C. to less that 100° C., or 48° C. to 100° C. Providing hydrolysis conditions may include providing a pH ranging from 4.8 to 5.0, a pH of 4.8, a pH of 4.9, or a pH of 5.0. At least one of the temperature, pH, or time of treatment, may be selected based on the specific activity of a CWD enzyme in the engineered plant material.

If the engineered plant material includes multiple CWD enzymes, conditions optimal for at least one of expression, pretreating, or hydrolysis by each of the multiple CWD enzymes may be provided sequentially. Hydrolysis conditions may include providing a pH optimal for activity of one enzyme, followed by a different pH optimal for activity of another enzyme. Hydrolysis conditions may include adjusting temperatures at different periods of time for optimal activity of each enzyme. For example, a xylanase may require a different temperature or pH than an endoglucanase.

The method may include adding one or more exogenous enzymes to at least one of the engineered plant material, other plant material, or the mixture. The exogenous enzymes may be added before, during, or after pretreating. The exogenous enzymes may be added before, during, or after providing hydrolysis conditions. Exogenous enzymes may be added to Saccharification vessel 50. One or more exogenous enzymes may be provided in an enzyme cocktail. An enzyme cocktail may include one or more CWD enzymes. A CWD enzyme provided in an embodiment herein may be but is not limited to a lignin degrading enzyme, a cellulose degrading enzyme, or a hemicellulose degrading enzyme. A CWD enzyme provided in an embodiment herein may be but is not limited to one selected from glycosidases, xylanases, cellulases, endo-glucanases, exoglucanases, cellobiohydrolases, β-xylosidases, feruloyl esterases, and amylases. An enzyme cocktail may include a cellulase isolated from *Trichoderma reesii*. An enzyme cocktail may be purchased from a vendor. An enzyme cocktail may be, but is not limited to, Accellerase™ 1000, Accellerase® 1500, and Accellerase® XY available from Genencor International (Rochester, N.Y.). An enzyme cocktail may be Cellic. An enzyme cocktail may include different classes of CWD enzymes. Optimal conditions for different classes of CWD enzymes in a cocktail may be provided. For example, the temperature, pH and time of treatment for hydrolysis may be adjusted during the method to provide optimal conditions for different enzymes in the cocktail. Hydrolysis conditions may include reduced loadings of external enzymes included in an enzyme cocktail. Reduced loadings may include formulations having less of or lacking a CWD protein or proteins expressed in engineered plant material. For example, if a transgenic plant expresses xylanase and endoglucanase, these enzymes may be removed from an enzyme cocktail formulated for hydrolysis of engineered plant material having the transgenic plant.

Efficiency of hydrolysis may be assessed by measuring solubilization of plant material. Methods to measure solubilization of plant material are known in the art and may include determining monosaccharide and disaccharide concentrations, for example by high performance liquid chromatography (HPLC). As described in Examples herein, HPLC may be performed using Shimadzu LC-20 AD binary pump with LC solutions software (Shimadzu, Kyoto, Japan) and sugar concentration may be determined using an Aminex HPX-87P sugar column (Bio-Rad Laboratories). Other methods to measure solubilization of plant material, for example, by determining weight loss, lignin removal, or deacetylation in the pretreated plant material, are available.

The method may further include contacting the mixture and/or products of hydrolysis with a fermenting organism to produce a biochemical product. After enzymatic hydrolysis, soluble sugars may be recovered and used for production of a biochemical product. Alternatively, simultaneous saccharification and fermentation of soluble sugars into a biochemical product may be performed in the method. A biochemical product may be but is not limited to butane, butanediol, butadiene, butanol, isobutanol, propane, propanediol, propylene, propanol, isopropanol, methane, methanol, ethanol, phenol, glycerol, ethylene, toluene, ethyl, benzene, styrene, xylene, ethylene glycol, ethylene oxide, formic acid, carbone dioxide, formaldehyde, acetaldehyde, acetone, a vitamin, ethane, pentane, hexane, heptane, octane, benzene, acetic acid, sorbitol, arabinitol, succinic acid, fumaric acid, malic acid, furan dicarboxylic acid, aspartic acid, glucaric acid, glutamic acid, itaconic acid, levulinic acid, hydroxybutyrolactone, glycerol, sorbitol, xylitol, arabinitol, gluconic acid, lactic acid, malonic acid, propionic acid, citric acid, aconitic acid, xylonic acid, furfural, levoglucosan, alanine, proline, lysine, serine, or threonine (See T. Werpy and G. Petersen, *Top Value Added Chemicals From Biomass*, Volume 1, Results of Screening for Potential Candidates from Sugars and Synthesis Gas, August 2004, Report, PNNL & NREL, which is incorporated herein by reference as if fully set forth). The method may include simultaneous saccharification and fermentation of soluble sugars to produce ethanol. Simultaneous saccharification and fermentation to produce ethanol may include providing *Saccharomyces cerevisiae* D5A before, during or after pretreating or providing hydrolysis conditions.

The conversion of sugars into desired biochemical products may be performed by any suitable fermenting organism. The fermenting organism may be selected based on the desired biochemical product. The fermenting organism may be yeast. The yeast may be but is not limited to one of *Saccharomyces*, *Kluyveromyces*, *Pichia*, *Yarrowia*, *Spathaspora* or *Scheffersomyces* ssp. The fermenting organism may be a bacterium. A bacterium may be but is not limited to a *Zymomonas*, *Escherichia*, *Bacillus*, *Lactobacillus*, or *Clostridium* ssp. The fermenting organism may be a wild type organism or a genetically engineered recombinant organism.

An embodiment includes an engineered plant including a first polynucleotide sequence encoding a first protein. The first protein may be a CWD protein. The first protein may be an intein-modified CWD protein. The first protein may by any one described with respect to the method for producing soluble sugars from engineered plant material. The first protein may include, consist essentially of, or consist of an amino acid sequence with at least 70, 72, 75, 80, 85, 90, 91, 92, 93, 94, 95, 96, 97, 98, 99, or 100% identity to a first reference sequence selected from the group consisting of: SEQ ID NO: 1 [WT P77853], SEQ ID NO: 2 [AnfaeA], SEQ ID NO: 3 [AnfaeB], SEQ ID NO: 4 [NtEGm], SEQ ID NO: 5 [EU591743], SEQ ID NO: 6 [O43097], SEQ ID NO: 7 [P77853:T134-100-101], SEQ ID NO: 8 [P77853:S158-30-108-35], SEQ ID NO: 9 [O33897], SEQ ID NO: 10 [O68438], and SEQ ID NO: 11 [P54583]. The first protein may include, consist essentially of, or consist of an amino acid sequence with at least 70, 72, 75, 80, 85, 90, 91, 92, 93, 94, 95, 96, 97, 98, 99, or 100% identity to the reference sequence of SEQ ID: 12 [BD22308].

The engineered plant may further include a second polynucleotide sequence encoding a second protein. The second protein may be a CWD enzyme. The second protein may be an intein-modified CWD protein. The second protein may by any one described with respect to the method for producing soluble sugars from engineered plant material. The second protein may include, consist essentially of, or consist of an amino acid sequence with at least 70, 72, 75, 80, 85, 90, 91, 92, 93, 94, 95, 96, 97, 98, 99, or 100% identity to a second reference sequence selected from the group consisting of: SEQ ID NO: 1 [WT P77853], SEQ ID NO: 2 [AnfaeA], SEQ ID NO: 3 [AnfaeB], SEQ ID NO: 4 [NtEGm], SEQ ID NO: 5 [EU 591743], SEQ ID NO: 6 [O43097], SEQ ID NO: 7 [P77853:T134-100-101], SEQ ID NO: 8 [P77853:S158-30-108-35], SEQ ID NO: 9 [O33897], SEQ ID NO: 10 [O68438], SEQ ID NO: 11 [P54583], and SEQ ID: 12 [BD22308]. The SEQ ID NO selected as the second reference sequence may be different than the SEQ ID NO selected as the first reference sequence.

The engineered plant may further include a third polynucleotide sequence encoding a third protein. The third protein may be a CWD enzyme. The third protein may be an intein-modified CWD protein. The third protein may by any one described with respect to the method for producing soluble sugars from engineered plant material. The third protein may include, consist essentially of, or consist of an amino acid sequence with at least 70, 72, 75, 80, 85, 90, 91, 92, 93, 94, 95, 96, 97, 98, 99, or 100% identity to a third reference sequence selected from the group consisting of: SEQ ID NO: 1 [WT P77853], SEQ ID NO: 2 [AnfaeA], SEQ ID NO: 3 [AnfaeB], SEQ ID NO: 4 [NtEGm], SEQ ID NO: 5 [EU591743], SEQ ID NO: 6 [O43097], SEQ ID NO: 7 [P77853:T134-100-101], SEQ ID NO: 8 [P77853:S158-30-108-35], SEQ ID NO: 9 [O33897], SEQ ID NO: 10 [O68438], SEQ ID NO: 11 [P54583], and SEQ ID: 12 [BD22308]. The SEQ ID NO selected as the third reference sequence may be different than the SEQ ID NO selected as the first reference sequence. The SEQ ID NO selected as the third reference sequence may be different than the SEQ ID NO selected as the second reference sequence.

At least one of the first polynucleotide sequence, the second polynucleotide sequence, or the third polynucleotide sequence in an engineered plant may further include a first targeting polynucleotide sequence encoding a respective targeting peptide. For an engineered plant lacking the third polynucleotide sequence, a first targeting polynucleotide sequence may be included on at least one of the first polynucleotide sequence or the second polynucleotide sequence. For an engineered plant lacking the second polynucleotide sequence and the third polynucleotide sequence, a first targeting polynucleotide sequence may be included on the first polynucleotide sequence. A respective targeting peptide may be independently selected from but is not limited to an amyloplast targeting signal, a cell wall targeting peptide, a mitochondrial targeting peptide, a cytosol localization signal, a chloroplast targeting signal, a nuclear targeting peptide, or a vacuole targeting peptide.

Each respective targeting peptide may be fused to the corresponding first protein, second protein, or third protein. A targeting peptide may have at least 70, 72, 75, 80, 85, 90, 91, 92, 93, 94, 95, 96, 97, 98, 99, or 100% identity to one of SEQ ID NO: 13 [BAASS], SEQ ID NO: 14 [HvAleSP], SEQ ID NO: 1 [PR1a] 5, SEQ ID NO: 16 [xGZein27ss-02], or SEQ ID NO: 17 [GluB4SP].

At least one of the first polynucleotide sequence, the second polynucleotide sequence, or the third polynucleotide sequence in an engineered plant may further include a second targeting polynucleotide sequence encoding a carboxy targeting peptide. For an engineered plant lacking the third polynucleotide sequence, a second targeting polynucleotide sequence may be included on at least one of the first polynucleotide sequence or the second polynucleotide sequence. For an engineered plant lacking the second polynucleotide sequence and the third polynucleotide sequence, a second targeting polynucleotide sequence may be included on the first polynucleotide sequence. A carboxy targeting peptide may be selected from but is not limited to sequence having at least 70, 72, 75, 80, 85, 90, 91, 92, 93, 94, 95, 96, 97, 98, 99, or 100 identity to one of SEQ ID NO: 22 [SEKDEL], the abridged SEQ ID NO: 23 [KDEL], or SEQ ID NO: 24 [the barley vacuolar sorting determinant sequence HvVSD-01]. A carboxy targeting peptide may be fused to at least one of the first protein, the second protein, or the third protein.

An engineered plant may include at least one polynucleotide sequence encoding an amino acid sequence including, consisting essentially of, or consisting of a sequence with at least 70, 72, 75, 80, 85, 90, 91, 92, 93, 94, 95, 96, 97, 98, 99, or 100% identity to a sequence selected from the group consisting of: SEQ ID NO: 18 [BAASS:P77853], SEQ ID NO: 19 [BAASS:O33897], SEQ ID NO: 20 [HVAlePS:NtEGm], SEQ ID NO: 21 [BAASS:P77853:S158-30-108-35], SEQ ID NO: 25 [BAASS: AnfaeB: SEKDEL], SEQ ID NO: 26 [BAASS:AnfaeA:SEKDEL], SEQ ID NO: 27 [PR1a:NtEGm:SEKDEL], SEQ ID NO: 28 [BAASS: P77853:T134-100-101:SEKDEL], SEQ ID NO: 29 [HvAleSP:NtEGm:SEKDEL], SEQ ID NO: 30 [BAASS:O43097:SEKDEL], and SEQ ID NO: 31 [xGZein27ss-02:BD22308:HvVSD-01].

An engineered plant may include at least one amino acid sequence including, consisting essentially of, or consisting of a sequence with at least 70, 72, 75, 80, 85, 90, 91, 92, 93, 94, 95, 96, 97, 98, 99, or 100% identity to a sequence selected from the group consisting of: SEQ ID NO: 18 [BAASS: P77853], SEQ ID NO: 19 [BAASS:O33897], SEQ ID NO: 20 [HVAlePS:NtEGm], SEQ ID NO: 21 [BAASS:P77853: S158-30-108-35], SEQ ID NO: 25 [BAASS: AnfaeB: SEKDEL], SEQ ID NO: 26 [BAASS:AnfaeA:SEKDEL], SEQ ID NO: 27 [PR1a:NtEGm:SEKDEL], SEQ ID NO: 28 [BAASS: P77853:T134-100-101:SEKDEL], SEQ ID NO: 29 [HvAleSP:NtEGm:SEKDEL], SEQ ID NO: 30 [BAASS: O43097:SEKDEL], and SEQ ID NO: 31 [xGZein27ss-02: BD22308:HvVSD-01].

The engineered plant may be a transgenic plant, progeny of a transgenic plant, a descendant of a transgenic plant, or any part of the foregoing. The engineered plant may include a CWD protein, which does not occur naturally in the plant, or a gene encoding the same. The CWD protein may be an intein-modified CWD protein. The transgenic plant may be any type of plant. The transgenic plant type may be maize, sugar cane, sugar beet, sorghum, switchgrass, miscanthus, eucalyptus, willow or poplar. The transgenic plant may be created by known methods to express a CWD enzyme or CWD protein in any form. The plant may be created by *Agrobacterium*-mediated transformation using a vector that includes a polynucleotide sequences encoding an enzyme. The transgenic plant may be created by other methods for transforming plants, for example, particle bombardment or direct DNA uptake. The transgenic plant may include any isolated nucleic acid, amino acid sequence, expression cassette, or vector herein.

In an embodiment, an expression cassette is provided that includes at least one of a first polynucleotide sequence, a second polynucleotide sequence, or a third polynucleotide sequence, which encode, respectively, a first protein, a second protein, and a third protein. Any one or more of the first protein, the second protein, or the third protein may be a CWD protein. Any one or more of the first protein, the second protein, or the third protein may be an intein-modified CWD protein. Any one or more of the first protein, the second protein, or the third protein may be one of the proteins described with respect to the method for producing soluble sugars from engineered plant material or the engineered plants. Any one or more of the first protein, the second protein, or the third protein may be a xylanase, an endoglucanase, an exoglucanase, a feruloyl esterase, an intein-modified xylanase, an intein-modified endoglucanase, an intein-modified exoglucanase, or an intein-modified feruloyl esterase. The protein selected as the second protein may be different than the protein selected as the first protein. The protein selected as the third protein may be different than the protein selected as the first protein. The protein selected as the third protein may be different than the protein selected as the second protein.

At least one of the first polynucleotide sequence, the second polynucleotide sequence, or the third polynucleotide sequence encoding a CWD protein in an expression cassette may be modified by insertion of the nucleic acid sequence encoding an intein. An intein-modified polynucleotide may encode an intein-modified protein with a modified function. A modified function may be inactivation of a CWD protein while the intein remains fused to or within the CWD protein. An intein in an intein-modified protein may be inducible to splice form the non-intein-modified protein. The induction condition for splicing may be but is not limited to providing a certain temperature. The temperature provided may be that provided during at least one of pretreating or hydrolysis conditions described with respect to the method for producing soluble sugars from engineered plant material. The induction condition may be any other induction condition that matches the intein selected. The intein-modified protein may be iXynA: i.e., intein-modified XynA. The intein-modified protein may be intein-modified P77853). The intein-modified protein may be P77853:T134-100-101 or P77853:S158-30-108-35.

One or more of the first protein, the second protein, or the third protein in an expression cassette may include, consist essentially of, or consist of an amino acid sequence with at least 70, 72, 75, 80, 85, 90, 91, 92, 93, 94, 95, 96, 97, 98, 99, or 100% identity to a reference sequence selected from the group consisting of: SEQ ID NO: 1 [WT P77853], SEQ ID NO: 2 [AnfaeA], SEQ ID NO: 3 [AnfaeB], SEQ ID NO: 4 [NtEGm], SEQ ID NO: 5 [EU 591743], SEQ ID NO: 6 [O43097], SEQ ID NO: 7 [P77853:T134-100-101], SEQ ID NO: 8 [P77853:S158-30-108-35], SEQ ID NO: 9 [O33897], SEQ ID NO: 10 [O68438], and SEQ ID NO: 11 [P54583]. One or more of the first protein, the second protein, or the third protein may include, consist essentially of, or consist of an amino acid sequence with at least 70, 72, 75, 80, 85, 90, 91, 92, 93, 94, 95, 96, 97, 98, 99, or 100% identity to the reference sequence of SEQ ID: 12 [BD22308].

At least one of the first polynucleotide sequence, the second polynucleotide sequence, or the third polynucleotide sequence in an expression cassette may further include a first targeting polynucleotide sequence encoding a respective targeting peptide. For an expression construct lacking the third polynucleotide sequence, a first targeting polynucleotide sequence may be included on at least one of the first polynucleotide sequence or the second polynucleotide sequence. For an expression construct lacking the second polynucleotide sequence and the third polynucleotide sequence, a first targeting polynucleotide sequence may be included on the first polynucleotide sequence. Each respective targeting peptide may be independently selected for each of the first polynucleotide sequence, the second polynucleotide sequence, or the third polynucleotide sequence. A targeting peptide may be fused to the first protein, the second protein, or the third protein. Each respective targeting peptide may be independently selected from but is not limited to an amyloplast targeting signal, a cell wall targeting peptide, a mitochondrial targeting peptide, a cytosol localization signal, a chloroplast targeting signal, a nuclear targeting peptide, and a vacuole targeting peptide. A first targeting polynucleotide may be upstream of the first polynucleotide sequence, the second polynucleotide sequence or the third polynucleotide sequence. A targeting peptide may have at least 70, 72, 75, 80, 85, 90, 91, 92, 93, 94, 95, 96, 97, 98, 99, or 100% identity to one of BAASS (SEQ ID NO: 13), the barley aleurone sequence HVAlePS (SEQ ID NO: 14), PR1a (SEQ ID NO: 15), the gamma-zein sequence xGZein27ss-02 (SEQ ID NO: 16), or GluB4SP (SEQ ID NO: 17). A first targeting polynucleotide sequence in combination with one of the first polynucleotide sequence, the second polynucleotide sequence, or the third polynucleotide sequence together may encode an amino acid sequence with at least 70, 72, 75, 80, 85, 90, 91, 92, 93, 94, 95, 96, 97, 98, 99, or 100% identity to a reference sequence selected from the group consisting of: SEQ ID NO: 18 [BAASS:P77853], SEQ ID NO: 19 [BAASS:O33897], SEQ ID NO: 20 [HVAlePS:NtEGm] and SEQ ID NO: 21 [BAAS:P77853:S158-30-108-35].

At least one of the first polynucleotide sequence, the second polynucleotide sequence, or the third polynucleotide sequence in an expression cassette may further include a second targeting polynucleotide sequence encoding a carboxy targeting peptide. For an expression construct lacking the third polynucleotide sequence, a second targeting polynucleotide sequence may be included on at least one of the first polynucleotide sequence or the second polynucleotide sequence. For an expression construct lacking the second polynucleotide sequence and the third polynucleotide sequence, a second targeting polynucleotide sequence may be included on the first polynucleotide sequence. A carboxy targeting peptide may be selected from but is not limited to sequence having at least 70, 72, 75, 80, 85, 90, 91, 92, 93, 94, 95, 96, 97, 98, 99, or 100 identity to one of SEKDEL (SEQ ID NO: 22), the abridged KDEL (SEQ ID NO: 23), or the barley vacuolar sorting determinant sequence HvVSD-01 (SEQ ID NO: 24). A carboxy targeting peptide may be fused to at least one of the first protein, the second protein, or the third protein.

An expression cassette may be configured such that at least one of the first protein, the second protein, or the third protein is be provided without the targeting peptide for accumulation in cytoplasm.

In an expression cassette, the first targeting polynucleotide sequence and the second targeting polynucleotide sequence in combination with one of the first polynucleotide sequence, the second polynucleotide sequence, or the third polynucleotide sequence together may encode an amino acid sequence with at least 70, 72, 75, 80, 85, 90, 91, 92, 93, 94, 95, 96, 97, 98, 99, or 100% identity to a reference sequence selected from the group consisting of: SEQ ID NO: 25 [BAASS: AnfaeB: SEKDEL], SEQ ID NO: 26 [BAASS:AnfaeA:SEKDEL], SEQ ID NO: 27 [PR1a:NtEGm:SEKDEL], SEQ ID NO: 28 [BAASS: P77853:T134-100-101:SEKDEL], SEQ ID NO: 29 [HvAleSP:NtEGm:SEKDEL], SEQ ID NO: 30 [BAASS:O43097:SEKDEL] and SEQ ID NO: 31 [xGZein27ss-02:BD22308:HvVSD-01].

Embodiments include an expression cassette encoding at least one of the first protein, the second protein, or the third protein, or variants thereof, fused to variants of at least one of a targeting peptide or a carboxy targeting peptide.

In an embodiment, a polynucleotide sequence that encodes a protein in an expression cassette and having less than 100% identity to the cited amino acid reference sequence may encode a variant of the protein having the amino acid reference sequence. In an embodiment, a protein having less than 100% identity to the cited amino acid reference sequence may be a variant of the protein having the amino acid reference sequence. In an embodiment, a polynucleotide sequence that encodes a protein having less than 100% identity to the protein encoded by the cited nucleic acid reference sequence may encode a variant of the protein encoded by the reference sequence.

In an expression cassette, at least one of the first polynucleotide sequence, the second polynucleotide sequence, or the third polynucleotide sequence may be capable of hybridizing to a reference sequence encoding a CWD protein or an intein-modified CWD protein under one of low, moderate, or high stringency conditions. At least one of the first, the second, or the third polynucleotide may be capable of hybridizing under conditions of one of low, moderate or high stringency conditions to a nucleic acid consisting of a reference sequence selected from the group consisting of: SEQ ID NO: 32 [WT P77853], SEQ ID NO: 33 [AnfaeA], SEQ ID NO: 34 [AnfaeB], SEQ ID NO: 35 [NtEGm], SEQ ID NO: 36 [EU591743], SEQ ID NO: 37 [O43097], SEQ ID NO: 38 [P77853:T134-100-101], SEQ ID NO: 39 [P77853:S158-30-108-35], SEQ ID NO: 40 [O33897], SEQ ID NO: 41 [O68438], SEQ ID NO: 42 [P54583], and SEQ ID NO: 43 [BD22308]. An expression cassette may include a polynucleotide sequence capable of hybridizing under conditions of one of low, moderate, or high stringency conditions to a nucleic acid consisting of a reference sequence selected from the group of sequences consisting of: SEQ ID NO: 52 [BAASS:P77853], SEQ ID NO: 53 [BAASS:O33897], SEQ ID NO: 54 [HVAlePS:NtEGm], SEQ ID NO: 55 [BAASS: P77853:S158-30-108-35], SEQ ID NO: 56 [BAASS: AnfaeB: SEKDEL], SEQ ID NO: 57 [BAASS:AnfaeA: SEKDEL], SEQ ID NO: 58 [PR1a:NtEGm:SEKDEL], SEQ ID NO: 59 [BAASS: P77853:T134-100-101:SEKDEL], SEQ ID NO: 60 [HvAleSP:NtEGm:SEKDEL], SEQ ID NO: 61 [BAASS:O43097:SEKDEL], and SEQ ID NO: 62 [xGZein27ss-02:BD22308:HvVSD-01].

An expression cassette herein may include a regulatory element.

In an embodiment, a vector including any isolated nucleic acid, polynucleotide sequence, or expression cassette herein is provided. Embodiments herein include a plasmid, chromosome, mitochondrial DNA, plastid DNA, virus or nucleic acid fragment having at least one expression cassette herein incorporated therein. An embodiment provides a vector for expressing CWD proteins in a plant. An embodiment provides a plant transformation vector. The plant transformation vector may be but is not limited to a T-DNA vector, a binary vector or a cointegrate vector. The transformation vector may include any isolated nucleic acid, polynucleotide sequence, or expression cassette herein.

An embodiment includes an expression vector including a polynucleotide sequence capable of hybridizing under conditions of one of low, moderate or high stringency conditions to nucleic acid consisting of a sequence including, consisting essentially of, or consisting of a sequence selected from the group consisting of: SEQ ID NO: 63 [pAG 2015], SEQ ID NO: 64 [pAG2048], SEQ ID NO: 65 [pAG2049], SEQ ID NO: 66 [pAG2063], SEQ ID NO: 67 [pAG2069], SEQ ID NO: 68 [pAG2091], SEQ ID NO: 69 [pAG2092], SEQ ID NO: 70 [pAG2096], SEQ ID NO: 71 [pAG2201], SEQ ID NO: 72 [pAG2229], SEQ ID NO: 73 [pAG2233], SEQ ID NO: 74 [pAG2234], SEQ ID NO: 75 [pAG2242], SEQ ID NO: 76 [pAG2252], SEQ ID NO: 77 [pAG2253], SEQ ID NO: 78 [pAG2309], SEQ ID NO: 79 [pAG2310], SEQ ID NO: 80 [pAG2339], SEQ ID NO: 81 [pAG2342], SEQ ID NO: 82 [pAG2345], and SEQ ID NO: 83 [pAG2349].

An embodiment includes an expression vector including a polynucleotide sequence having at least 70, 72, 75, 80, 85, 90, 91, 92, 93, 94, 95, 96, 97, 98, 99, or 100% identity to a sequence selected from the group consisting of: SEQ ID NO: 63 [pAG 2015], SEQ ID NO: 64 [pAG2048], SEQ ID NO: 65 [pAG2049], SEQ ID NO: 66 [pAG2063], SEQ ID NO: 67 [pAG2069], SEQ ID NO: 68 [pAG2091], SEQ ID NO: 69 [pAG2092], SEQ ID NO: 70 [pAG2096], SEQ ID NO: 71 [pAG2201], SEQ ID NO: 72 [pAG2229], SEQ ID NO: 73 [pAG2233], SEQ ID NO: 74 [pAG2234], SEQ ID NO: 75 [pAG 2242], SEQ ID NO: 76 [pAG2252], SEQ ID NO: 77 [pAG2253], SEQ ID NO: 78 [pAG2309], SEQ ID NO: 79 [pAG2310], SEQ ID NO: 80 [pAG2339], SEQ ID NO: 81 [pAG2342], SEQ ID NO: 82 [pAG2345], and SEQ ID NO: 83 [pAG2349].

Methods of hybridization and stringency conditions are known in the art and are described the following books: Molecular Cloning, T. Maniatis, E. F. Fritsch and J. Sambrook, Cold Spring Harbor Laboratory, 1982, and Current Protocols in Molecular Biology, F. M. Ausubel, R. Brent, R. E. Kingston, D. D. Moore, J. G. Siedman, J. A. Smith, K. Struhl, Volume 1, John Wiley & Sons, 2000, which are incorporated hereby by reference as if fully set forth.

Moderate conditions may be as follows: filters loaded with DNA samples are pretreated for 2-4 hours at 68° C. in a solution containing 6× citrate buffered saline (SSC; Amresco, Inc., Solon, Ohio), 0.5% sodium dodecyl sulfate (SDS; Amresco, Inc., Solon, Ohio), 5×Denhardt's solution (Amresco, Inc., Solon, Ohio), and denatured salmon sperm (Invitrogen Life Technologies, Inc. Carlsbad, Calif.). Hybridization is carried in the same solution with the following modifications: 0.01 M EDTA (Amresco, Inc., Solon, Ohio), 100 μg/ml salmon sperm DNA, and 5-20×$10^6$ cpm $^{32}$P-labeled or fluorescently labeled probes. Filters are incubated in hybridization mixture for 16-20 hours and then washed for 15 minutes in a solution containing 2×SSC and 0.1% SDS. The wash solution is replaced for a second wash with a solution containing 0.1×SSC and 0.5% SDS and incubated an additional 2 hours at 20° C. to 29° C. below Tm (melting temperature in ° C.). $Tm=81.5+16.61\ Log_{10}([Na^+]/(1.0+0.7[Na^+]))+0.41(\%[G+C])-(500/n)-P-F$. [Na+]=Molar concentration of sodium ions. %[G+C]=percent of G+C bases in DNA sequence. N=length of DNA sequence in bases. P=a temperature correction for % mismatched base pairs (~1° C. per 1% mismatch). F=correction for formamide concentration (=0.63° C. per 1% formamide). Filters are exposed for development in an imager or by autoradiography. Low stringency conditions refers to hybridization conditions at low temperatures, for example, between 37° C. and 60° C., and the second wash with higher [$Na^+$] (up to 0.825M) and at a temperature 40° C. to 48° C. below Tm. High stringency refers to hybridization conditions at high temperatures, for example, over 68° C., and the second wash with [Na+]=0.0165 to 0.0330M at a temperature 5° C. to 10° C. below Tm.

An embodiment provides an isolated nucleic acid sequence having a sequence that hybridizes under one of low, moderate, or high stringency conditions to a nucleic acid consisting of a sequence selected from SEQ ID NO: 32 [WT P77853], SEQ ID NO: 33 [AnfaeA], SEQ ID NO: 34 [AnfaeB], SEQ ID NO: 35 [NtEGm], SEQ ID NO: 36 [EU591743], SEQ ID NO: 37 [O43097], SEQ ID NO: 38 [P77853:T134-100-101], and SEQ ID NO: 39 [P77853:S158-30-108-35], of SEQ ID NO: 40 [O33897], SEQ ID NO: 41 [O68438], SEQ ID NO: 42 [P54583], and SEQ ID: 43 [BD22308], SEQ ID NO: 52

[BAASS:P77853], SEQ ID NO: 53 [BAASS:O33897], SEQ ID NO: 54 [HVAlePS:NtEGm], SEQ ID NO: 55 [BAASS: P77853:S158-30-108-35], SEQ ID NO: 56 [BAASS: AnfaeB: SEKDEL], SEQ ID NO: 57 [BAASS:AnfaeA: SEKDEL], SEQ ID NO: 58 [PR1a:NtEGm:SEKDEL], SEQ ID NO: 59 [BAASS: P77853:T134-100-101:SEKDEL], SEQ ID NO: 60 [HvAleSP:NtEGm:SEKDEL], SEQ ID NO: 61 [BAASS:O43097:SEKDEL] and SEQ ID NO: 62 [xGZein27ss-02:BD22308:HvVSD-01], SEQ ID NO: 63 [pAG 2015], SEQ ID NO: 64 [pAG2048], SEQ ID NO: 65 [pAG2049], SEQ ID NO: 66 [pAG2063], SEQ ID NO: 67 [pAG2069], SEQ ID NO: 68 [pAG2091], SEQ ID NO: 69 [pAG2092], SEQ ID NO: 70 [pAG2096], SEQ ID NO: 71 [pAG2201], SEQ ID NO: 72 [pAG2229], SEQ ID NO: 73 [pAG2233], SEQ ID NO: 74 [pAG2234], SEQ ID NO: 75 [pAG 2242], SEQ ID NO: 76 [pAG2252], SEQ ID NO: 77 [pAG2253], SEQ ID NO: 78 [pAG2309], SEQ ID NO: 79 [pAG2310], SEQ ID NO: 80 [pAG2339], SEQ ID NO: 81 [pAG2342], SEQ ID NO: 82 [pAG2345], and SEQ ID NO: 83 [pAG2349], or the complement thereof.

An embodiment provides a fragment of any of the above isolated nucleic acids. The fragment may be a hybridization probe or primer. The probe or primer may have any length. The probe or primer may be 6, 10, 15, 20, 25, 30, 35, 40, 45, or 50 nucleotides in length, or have a length in a range between any two of the foregoing lengths (endpoints inclusive). A fragment may have a length less than the full length and/or include substitutions or deletions in comparison to cited reference sequence. The fragment may be a variant of the cited reference sequence. A peptide encoded by a fragment may have a length less than the full length and/or include substitutions or deletions in comparison to the amino acid sequence encoded by the cited reference sequence. The peptide with a length less than full length may be a variant of the amino acid sequence encoded by the cited reference sequence.

An expression cassette may be generated recombinantly by known methods. An expression cassette may include a series of specified nucleic acid elements, which permit transcription of a particular nucleic acid in a plant cell or plant tissue. The expression cassette may include a polynucleotide sequence encoding a protein. The protein may be a CWD enzyme or an intein-modified CWD enzyme. The CWD enzyme may be selected from the list of CWD enzymes consisting of: xylanases, endoglucanases, exoglucanases, xylosidases, glucosidases and feruloyl esterases.

A polynucleotide sequence in an expression cassette, isolated nucleic acid, vector, or any other DNA construct herein, or utilized in a method herein may be operably connected to one or more regulatory element. A regulatory element included may be a promoter. The promoter may be a constitutive promoter which provides transcription of the polynucleotide sequences throughout the plant in most cells, tissues and organs and during many but not necessarily all stages of development. The promoter may be an inducible promoter, which initiates transcription of the polynucleotide sequences only when exposed to a particular chemical or environmental stimulus. The promoter may be specific to a particular developmental stage, organ or tissue. A tissue specific promoter may be capable of initiating transcription in a particular plant tissue. Plant tissue that may be targeted by a tissue specific promoter may be but is not limited to a stem, leaves, trichomes, anthers, or seed. A constitutive promoter herein may be the rice Ubiquitin 3 promoter (OsUbi3P) or rice Actin 1 promoter. Other known constitutive promoters may be used, and include but are not limited to Cauliflower Mosaic Virus (CAMV) 35S promoter, the Cestrum Yellow Leaf Curling Virus promoter (CMP) or the CMP short version (CMPS), the Rubisco small subunit promoter, and the maize ubiquitin promoter. The tissue specific promoter may include the seed-specific promoter. The seed specific promoter may be but is not limited to the rice GluB4 promoter or the maize zein promoter. Another regulatory element that may be provided is a terminator sequence, which terminates transcription. A terminator sequence may be included at the 3' end of a transcriptional unit of the expression cassette. The terminator may be derived from a variety of plant genes. The terminator may be a terminator sequence from the nopaline synthase or octopine synthase genes of *Agrobacterium tumefaciens*.

Vectors incorporating an expression cassette herein may also include additional genetic elements such as multiple cloning sites to facilitate molecular cloning and selection markers to facilitate selection. A selectable marker that may be included in a vector may be a phosphomannose isomerase (PMI) gene from *Escherichia coli* which confers to the transformed cell the ability to utilize mannose for growth. A Selectable markers that may be included in a vector include but are not limited to a neomycin phosphotransferase (npt) gene conferring resistance to kanamycin, a hygromycin phosphotransferase (hpt) gene conferring resistance to hygromycin, and an enolpyruvylshikimate-3-phosphate synthase gene conferring resistance to glyphosate.

In an embodiment, the vector may be constructed to include polynucleotide sequences encoding multiple CWD enzymes. A vector herein may further include a polynucleotide sequence designed to silence a gene or genes in a plant.

An expression vector may be introduced into suitable host cells, tissues, organs and/or organisms. Suitable hosts may be dicotyledonous (dicots) or monocotyledonous (monocots) plants.

Further embodiments herein may be formed by supplementing an embodiment with one or more element from any one or more other embodiment herein, and/or substituting one or more element from one embodiment with one or more element from one or more other embodiment herein. Further embodiments herein may be described by reference to any one of the appended claims following claim 1 and reading the chosen claim to depend from any one or more preceding claim.

EXAMPLES

The following non-limiting examples are provided to illustrate particular embodiments. The embodiments throughout may be supplemented with one or more detail from one or more example below, and/or one or more element from an embodiment may be substituted with one or more detail from one or more example below.

Example 1

Materials and Methods

Vectors

A vector design herein is based on the pSB11 intermediate plasmid available from Japan Tobacco and described in the International application Nos. PCT/US10/55746 filed Nov. 5, 2010, PCT/US10/55669 filed Nov. 5, 2010 and PCT/US10/55751 filed Nov. 5, 2010, which are incorporated herein by reference as if fully set forth. Briefly, the pSB11 plasmid used for cloning is conjugated with the pSB1 acceptor vector, a disarmed Ti plasmid, through homologous recombination using cos and ori sites present in both pSB11 and pSB1. The integrated vector contains virulence genes such as virB, virC and vir G required for T-DNA transfer and may be used for plant transformation. The base transformation vector includes an expression cassette containing a man A gene encoding PMI under the control of the CMPS promoter later replaced by the OsUbi3P promoter. This base vector was used to obtain the vectors listed below, which were used for plant transformation and expression of cell wall degrading enzymes in planta:

1. pAG2015 (SEQ ID NO: 63): OsUbi3P:P77853;
2. pAG2048 (SEQ ID NO: 64): OsUbi3P:HvAleSP: NtEGm between rice Ubi3 promoter fused to vacuole;
3. pAG2049 (SEQ ID NO: 65): OsUbi3P:HvAleSP: NtEGm: SEKDEL;
4. pAG2063 (SEQ ID NO: 66): OsUbi3P:BAASS: O43097:SEKDEL;
5. pAG2069 (SEQ ID NO: 67): OsUbi3P:O68438;
6. pAG2091 (SEQ ID NO: 68): OsUbi3P:BAASS: AnfaeA:SEKDEL+OsUbi3P:BAASS:P77853;
7. pAG2092 (SEQ ID NO: 69): OsUbi3P:BAASS:AnfaeB: SEKDEL+OsUbi3P:BAASS:P77853;
8. pAG2096 (SEQ ID NO: 70): OsUbi3P:BAASS:AnfaeA:SEKDEL+OsUbi3P:BAASS:AnfaeB:SEKDEL+ OsUbi3P:BAASS:P77853;
9. pAG2201 (SEQ ID NO: 71): OsUbi3P:ZmUBQm: P77853;
10. pAG2229 (SEQ ID NO: 72): OsUbi3P:BAASS: P77853:T134-100-101:SEKDEL (intein modified xylanase);
11. pAG2233 (SEQ ID NO: 73) OsUbi3P:P77853:5158-30-108-35;
12. pAG2234 (SEQ ID NO: 74) OsUbi3P:BAASS: P77853:5158-30-108-35;
13. pAG2242 (SEQ ID NO: 75): OsUbi3P:PR1aSP: NtEGm:SEKDEL+OsUbi3P:ZmUBQm:P77853;
14. pAG2252 (SEQ ID NO: 76): OsUbi3P:O33897 (endoglucanase);
15. pAG2253 (SEQ ID NO: 77): OsUbi3P:BAASS: O33897;
16. pAG2309 (SEQ ID NO: 78): OsUbi3P:HvAleSP: NtEGm+OsUbi3P:P77853;
17. pAG2310 (SEQ ID NO: 79): OsUbi3P:EU591743 (xylanase);
18. pAG2339 (SEQ ID NO: 80): OsUbi3P:O68438+ OsUbi3P:BAASS:O33897+OsUbi3P:EU591743;
19. pAG2342 (SEQ ID NO: 81): OsUbi3P:HvAleSP: NtEGm: SEKDEL+OsUbi3P:P77853;
20. pAG2345 (SEQ ID NO: 82): OsUbi3P:O68438+ OsUbi3P:HvAleSP:NtEGm:SEKDEL+OsUbi3P:BAASS: O43097:SEKDEL;
21. pAG2349 (SEQ ID NO: 83): ZmUbi1P:ZmKozak: xGZein27ss-02:BD22308:HvVSD-01+OsUbi3P:HvAleSP: NtEGm:SEKDEL+OsUbi3P:BAASS: O43097:SEKDEL;
22. pAG2042 (SEQ ID NO: 84): P54583 (endoglucanase EGB)

Production of Transgenic Maize Plants

The methods for maize and switchgrass transformation were described in the International application Nos. PCT/US10/55746 filed Nov. 5, 2010, PCT/US10/55669 filed Nov. 5, 2010, PCT/US10/55751 filed Nov. 5, 2010 and Gray et al. 2011 Plant Biotech J 9:1100, which are all incorporated herein by reference as if fully set forth. Briefly, embryogenic callus from wild-type A×B maize was inoculated with LBA4404 Agrobacterium cells harboring the appropriate transformation plasmid. Agrobacterium-mediated transformation of immature maize embryos was performed as described previously (Negrotto D et al. 2000 Plant Cell Rep 19: 798; Ishida Y et al. 1996 Nat Biotech 14: 745). The expression cassettes for enzyme genes were cloned into the KpnI-EcoRI sites of the pAG2004 (SEQ ID NO: 85) vector to generate an intermediate vector capable of recombining with the pSB1 vector in triparental mating in *Agrobacterium tumefaciens* strain LBA4404 using procedures reported previously (Ishida Y et al. 1996 Nat Biotech 14: 745; Hiei Y et al. 1994 Plant J 6: 271; Hiei Y and Komari T 2006 Plant Cell Tissue Organ Cult. 85: 27; Komari T et al. 1996 Plant J 10: 165). Maize (*Zea mays* cultivars HiII, A188 or B73) stock plants were grown in a greenhouse under 16 hours of daylight at 28° C. Immature zygotic embryos were isolated from the kernels and inoculated with the *Agrobacterium* solution containing the genes of interest. After inoculation immature embryos were grown in a tissue culture process for 10-12 weeks. Well-developed seedlings with leaves and roots were sampled for PCR analysis to identify transgenic plants containing the genes of interest. PCR positive and rooted plants were rinsed with water to wash off the agar medium, and transplanted to soil and grown in the greenhouse to generate seeds and stover.

Particular transgenic plants are referred to herein by an enzyme designation (e.g.; "P77853," "P40942," "O30700," "NtEGm," etc.) or transgenic control (e.g.; "TGC," etc.) followed by a number in the thousands that designates the plasmid used to create the transgenic plant (e.g.; "2014," "2015," "2229," "2092," etc.). Additional characters are inserted occasionally, but the i) enzyme or control and ii) plasmid designation are clear in context. The plasmids referred to are named pAGXXXX. For example, the designations "2229," "2252," "2253," "2092," "2096," or "2042" in a transgenic plant name means that the transgenic plant was made by transformation with "pAG2229," "pAG2252," "pAG2253," "pAG2092," "pAG2096," or "pAG2042," respectively. Reference can be made to the incorporated sequences labeled with the plasmid names to determine sequences used to make a particular transgenic plant.

For generating transgenic switchgrass plants, seeds from *Panicum virgatum*, cv. Alamo were used for initiating embryogenic callus lines subsequently used for transformation using *Agrobacterium* LBA4404 harboring pSB1 plasmid. The presence of the gene of interest was confirmed by PCR using gene specific primers.

The following transgenic plants expressing a CWD enzyme or CWD enzymes and control plants were used for consolidated pretreatment and hydrolysis:

1. Wild type maize plant used as negative controls (A×B; B×A);
2. Maize plants transformed with an empty vector used as negative controls (TGC.4000.12; TGC.4000.11; TGC.2004.8.02; TGC.2004.8.04; TGC.2243.01);
3. A transgenic maize plant XynA.2015.05 made by transformation with pAG2015 and expressing xylanase XynA (P77853);
4. A second generation transgenic maize plant XynA.2015.5T1 made by transformation with pAG2015 and expressing xylanase XynA (P77853);
5. A transgenic maize plant XynB.2063.17 made by transformation with pAG2063 and expressing xylanase XynB (O43097);
6. Transgenic maize plants EGA.2049.02 and EGA.2049.10 made by transformation with pAG2049 and expressing endoglucanase EGA (NtEG);
7. A transgenic maize plant EGB.2042.03 made by transformation with pAG2042 and expressing endoglucanase EGB (P54583);
8. A transgenic maize plant EGC.2253.4b made by transformation with pAG2253 and expressing endoglucanase EGC (O33897);

9. A transgenic maize plant EGA/XynA.2242.09 made by transformation with pAG2242 and expressing endoglucanase EGA (NtEG) and xylanase XynA (P77853);

10. A second generation transgenic maize plant of plant 9, above, called EGA/XynA.2242.09.16T1 and expressing endoglucanase EGA (NtEG) and xylanase XynA (P77853);

11. A transgenic maize plant XynA/AccB.2092.103 made by transformation with pAG2092 and expressing xylanase XynA (P77853) and feruloyl esterase B from *Aspergillus niger*;

12. Transgenic maize plants XynA/AccA/B.2096.01 and XynA/AccA/B.2096.05 made by transformation with pAG2096 and expressing xylanase XynA (P77853), Feruloyl esterase A from *Aspergillus niger*, and feruloyl esterase B from *Aspergillus niger*;

13. A transgenic maize plant CBHA.2069.3.17 made by transformation with pAG2069 and expressing exoglucanase CBH (O68438);

14. Transgenic switchgrass plants XynA.pv2015.3c and XynA.pv2015.4c made by transformation with pAG2015 and expressing xylanase XynA (P77853);

15. A transgenic maize plant iXynA.2229.110 made by transformation with pAG2229 and expressing intein modified xylanase XynA (P77853);

16. Transgenic maize plants XynA/EGA.2309.54 and XynA/EGA.2309.107 made by transformation with pAG2309 and expressing XynA (P77853), endoglucanase EGA(NtEGm);

17. A transgenic maize plant XynA/EGA.2342.105 made by transformation with pAG2342 and expressing XynA (P77853) and EGA(NtEGm);

18. Transgenic maize plants XynE/EGC/CBHA.2339.03, XynE/EGC/CBHA.2339.04, and XynE/EGC/CBHA.2339.05 made by transformation with pAG2339 and expressing XynE (EU591743), endoglucanase EGC (O33897), and CBHA (068438);

19. A transgenic maize plant XynB/EGA/CBHA.2345.116 made by transformation with pAG2345 and expressing XynB (O43097), endoglucanase EGA (NtEGm), and CBHA (O68438);

20. Transgenic maize plants XynB/EGA/CBHB.2349.55 and XynB/EGA/CBHB.2349.56 made by transformation with pAG2349 and expressing XyanB (O43097), endoglucanase EGA (NtEG), CBHB (BD22308), and ZmUbi1P:ZmKozak:xGZein27ss-02:BD22308:HvVSD-01:NosT.

Plant Stover

Harvested greenhouse maize stover was dried in an air circulator at 37° C. for 1-2 weeks. After drying, the stover was cut manually to 1.0-1.5 inch pieces and then milled using an UDY mill (Model 014, UDY Corporation, Fort Collins, Colo.) with a 0.5 mm screen.

Preparation of Plant Protein Extracts

Individual crushed grains or 20 mg milled stover were resuspended in protein extraction buffer that include 100 mM sodium phosphate (pH 6.5), ethylenediaminetetraacetic acid (EDTA; 1 mM), Triton X-100 (0.1%, v/v) and phenylmethanesulfonylfluoride (PMSF; 0.1 mM). Resuspended tissue samples were mixed thoroughly, and insoluble material was then sedimented by centrifugation. The supernatant liquid-containing soluble protein was transferred to a new tube.

Chemicals and Enzymes

Sugar standards (glucose, xylose, arabinose, galactose, mannose and cellobiose) were purchased from Acros Organics (Morris Plains, N.J.). All other chemicals used in this study were purchased from Sigma-Aldrich (St. Louis, Mo.). Endoglucanase (C8546), β-glycosidase (49291), and endoxylanase (X2753) for making in house cocktail were all purchased from Sigma (St. Louis, Mo.). The cellobiohydrolase (CBHI) (EC 3.2.1.91) and β-xylosidase (EC 3.2.1.37) were purchased from Megazyme (Wicklow, Ireland). Accellerase® 1500 and Accellerase® XY were generous gifts from Genencor International (Rochester, N.Y.). The yeast *Saccharomyces cerevisiae*, strain D5A was obtained from the American Type Culture Collection (ATCC) (Manassas, Va.).

Stover Enzyme Assays

Protein was extracted from 15 mg stover in 500 μl extraction buffer (100 mM sodium phosphate buffer, pH 6.5; NaOAc, pH 4.5; or Tris, pH 8.0, EDTA (10 mM), and Triton X-100 (0.1%) after incubation for 30 minutes at room temperature. The stover was spun down by centrifugation. The supernatant was collected and transferred to a new Eppendorf tube. For enzyme assays, 50 μl protein extract was resuspended in a buffer. Typically, the buffer included Xylazyme in 100 mM Na phosphate, pH 6.5 or Cellazyme in 100 mM NaOAc, pH 4.5. Xylazyme AX or cellazyme tablets were used as was appropriate for each tube of enzyme assay. The reactions were incubated at the assay temperature (usually approximately 50-60° C., depending on the enzyme being tested) until a blue color was visible in the supernatant liquid. The amount of blue dye was quantified by measuring absorbance of the reaction at 590 nm. Controls for these reaction included microbially raised enzymes and extracts from wild type plants. Hydrolysis substrates may be also determined by using AZCL-conjugated substrate (Megazyme) instead of the xylazyme AX and cellazyme tablets. Using the AZCL-conjugated substrate allows for optimization of both the volume of stover being tested and the concentration of substrate.

Detection of Xylanase Activity

Soluble proteins were assayed using Xylazyme AX (Megazyme, Bray, Co. Wicklow, Ireland) as a substrate in 0.5-ml reactions at 50° C. in HEPES buffer (100 mM, pH 8.0) for BSX or in sodium phosphate (100 mM, pH 6.5) for XynB. To stop the Xylazyme AX reactions, 1 ml 2% (w/v) Tris base was added to the reactions. The insoluble material from the Xylazyme AX reaction was sedimented by centrifugation, and the absorbance of the reaction 100 μL of the supernatant was measured in triplicate spectrophotometrically at 590 nm. For quantification of BSX or XynB accumulation levels, calibration curves were constructed by incubating known amounts of purified, microbially raised BSX or XynB diluted in assay buffer with Xylazyme AX tablets concurrent with the Xylazyme AX assays using transgenic plant material.

Table 1 below demonstrates the enzyme activities detected in transgenic plants. As indicated, the enzyme activities were detected for several xylanases, endoglucanases, cellobiohydrolases and feruloyl esterases. For each transgenic event, the detected enzyme activity was also confirmed by Western blot analysis. "N/A" refers to analysis not yet performed.

TABLE 1

| Transgenic plant | Xylanase | Endoglucanase | CBH | AccA or B |
|---|---|---|---|---|
| A × B | − | − | − | − |
| B × A | − | − | − | − |
| TGC.2243.01 | − | − | − | − |
| TGC.4000.12 | − | − | − | − |
| TGC.4000.11 | − | − | − | − |
| TGC.2004.8.02 | − | − | − | − |
| TGC.2004.8.04 | − | − | − | − |
| TGC.2243.01 | − | − | − | − |
| XynA.2015.05 | + | − | − | − |
| XynA.2015.5T1 | + | − | − | − |
| XynB.2063.17 | + | − | − | − |
| EGA.2049.02 | − | + | − | − |

TABLE 1-continued

| Transgenic plant | Xylanase | Endoglu-canase | CBH | AccA or B |
|---|---|---|---|---|
| EGA.2049.10 | − | + | − | − |
| EGB.2042.03 | − | + | − | − |
| EGC.2253.4b | − | + | − | − |
| EGA/XynA.2242.09 | + | + | − | − |
| EGA/XynA.2242.09.16T1 | + | + | − | − |
| XynA/AccB.2092.103 | + | − | − | + |
| XynA/AccA/B.2096.01 | + | − | − | + |
| XynA/AccA/B.2096.05 | + | − | − | + |
| XynA.pv2015.3c | + | − | − | − |
| XynA.pv2015.4c | + | − | − | − |
| iXynA.2229.110 | + | − | − | − |
| XynA/EGA.2309.54 | + | + | − | − |
| XynA/EGA.2309.107 | + | + | − | − |
| XynA/EGA.2342.105 | + | + | − | − |
| XynE/EGC/CBHA.2339.03 | + | + | N/A | − |
| XynE/EGC/CBHA.2339.04 | + | + | N/A | − |
| XynE/EGC/CBHA.2339.05 | + | + | N/A | − |
| XynB/EGA/CBHA.2345.116 | + | + | N/A | − |
| XynB/EGA/CBHB.2349.55 | + | + | + | − |
| XynB/EGA/CBHB.2349.56 | + | + | + | − |

Biomass Carbohydrate Compositional Analysis

Prior to carbohydrate compositional analysis, duplicates of 3.0 g of air-dried milled stover were refluxed with 90% (v/v) ethanol using a glass Soxhlet extraction system (Fisher Scientific, Pittsburg, Pa.) to remove the ethanol-extractable materials by following NREL standards (NREL/TP-510-42619). The ethanol containing extracts were vacuum evaporated using a rotary evaporator equipped with a water bath set to 40° C. (Heidolph LR4000 G5B, IL USA). Extract content was determined by the weight of the solids in the flask after oven drying at 50° C. for 48 hours.

The extract-free stover was subject to a two-step acid hydrolysis (NREL/TP-510-42618), which was the first hydrolyzed at 30° C. with 1.5 ml of 72% (w/w) $H_2SO_4$ per 0.16-0.18 g (air dry weight) for 60 min, followed by 121° C. for 1 hour with supplementation of 42.0 ml of water. After acid hydrolysis, sodium hydroxide and calcium hydroxide were added to adjust the pH to between 4.0 and 9.0 and all samples were filtered through a 0.2 µm PVDF filters (Fisher Scientific, Pittsburg, Pa.) for high performance liquid chromatography (HPLC) analysis.

Consolidated Process with Moderate Pretreatment and Saccharification

To evaluate the effect of plant expressed CWD enzymes on stover hydrolysis, a consolidated process was developed includes a mild pretreatment followed by enzymatic hydrolysis without inter-stage washing of the biomass/detoxification. The consolidated process removes any washing/separation/detoxification steps and allows an integrated pretreatment and simultaneous saccharification and fermentation (SSF) process.

Moderate Pretreatment

An efficient mild pretreatment was developed that can achieve some pretreatment effects on biomass but not deactivate the hydrolytic enzymes within the plant. The pretreatment chemical was a mixture of 0.02M-0.18 M ammonium bisulfite and 0.025M-0.20 M ammonium carbonate with pH between 5.0 and 9.0, preferably around 8.10. For evaluating plant stover hydrolysis, 20.0 mg milled corn stover was added to 2-ml microcentrifuge tubes with pretreatment chemical solution at a liquor-to-solid (L/S) ratio of 10 or less (preferably 3-6). The pretreatment was incubated in a shaker at 350 rpm and a temperature of 40° C.-95° C. for 0-16 hours. For milled and unmilled stover, a mechanical refining or defibrillation followed the pretreatment with chemicals. Further, the pretreated material was subject to enzymatic hydrolysis without inter-stage washing.

Enzymatic Hydrolysis

The pretreated stover was subject to enzymatic hydrolysis in Britton-Robinson polybuffer (40 mM phosphate, 40 mM acetate, 40 mM borate) with sodium azide. The enzymatic hydrolysis was conducted at 2% (w/v) solids content, pH 4.9, 50° C. in a New Brunswick shaker (New Brunswick Scientific, New Jersey USA) at 250 rpm for varying time (0-144 hours). Cocktail #1 was loaded as 0.5 µM endoglucanase, 0.1 µM cellobiohydrolase (CBHI), 0.05 µM β-glycosidase, and 0.5 µM endoxylanase based on 10.0 mg stover with 1 ml reaction volume. Cocktail 5# was the cocktail #1 with 0.1 µM β-xylosidase added. In conjunction, three types of enzymatic hydrolysis were run in parallel: No enzyme cocktail (NCt), a full enzyme cocktail (FCt), and an enzyme cocktail lacking the in-planta expressed enzyme (Ct-PE), e.g., an enzyme cocktail lacking endoxylanase (Ct-Xyn) or endoglucanase (Ct-EG) or both (Ct-EG-Xyn) depending on the enzyme expressed in plants. Accellerase® 1500 was loaded at 0.2 ml/g dry mass and Accellerase® XY was loaded at 0.1 ml/g dry mass. Glucose and xylose yields (% of theoretical) were expressed as a percentage of total Glucose and xylose in each substrate. Error bars in the accompanying FIGS. are the standard deviation of the mean from replicate assays.

Simultaneous Saccharification and Fermentation (SSF)

The inoculum was prepared by growing the yeast strain *Saccharomyces cerevisiae* D5A to an $OD_{600}$ of 0.5 in YPD (10 g/l yeast extract, 20 g/l peptone and 20 g/l dextrose) at 30° C. and 250 rpm. The cells were harvested by centrifugation (3000 g for 5 min) and re-suspended in a 1×YP (10 g/l yeast extract and 20 g/l peptone).

SSF experiments were performed in duplicate in 250 ml Erlenmeyer glass flasks with a working volume of 50 ml, consisting of 3.0-4.0 g (dry weight) pretreated biomass, Britton-Robinson buffer, 10×YP (100 g/l yeast extract and 200 g/l peptone), inocula, and hydrolytic enzymes. The flasks were sealed by a rubber stopper with an airlock. The experiments were started by adding yeast inocula and enzymes (Accellerase® 1500 at 10 FPU/g dry mass and Accellerase® XY at 0.1 ml/g dry mass), and were incubated at 35° C. and 120 rpm for 7 days. Samples were withdrawn after 0, 24, 48, 72, 144 and 168 hours and analyzed for ethanol and sugars.

Analysis of Fermentable Sugars and Ethanol

The hydrolysate samples were heated at 90° C. for 20 min and then centrifuged at 10,000 g, following which the supernatants were clarified by passing through 0.20 µm PVDF filters (Cat. #: 09-910-13, Fisher Scientific, Pittsburg, Pa.). Monosaccharide and disaccharide concentrations were determined by high performance liquid chromatography (HPLC), using a Shimadzu LC-20 AD binary pump with LC solutions software (Shimadzu, Kyoto, Japan). Sugar concentrations were determined using an Aminex HPX-87P sugar column (Bio-Rad Laboratories, Hercules, Calif.) operating at 0.6 ml/min and 80° C. with degassed water as the mobile phase. Ethanol concentration in fermentation broth was analyzed using an Aminex HPX-87H Column (Bio-Rad Laboratories, Hercules, Calif.) acid column operating at 0.6 ml/min, 60° C. with 0.004 M sulfuric acid as the mobile phase. Peak areas for all samples, analyzed with an RI detector (RID 10AD), were integrated and the values were compared to standard curves for quantification.

Example 2

Plant Stover Carbohydrate Compositional Analysis

The stover from transgenic plants was characterized in terms of their structural carbohydrate composition and the sugar content to examine any significant changes caused by genetic modification. Table 2 shows results of the structural carbohydrate analysis of random sampled transgenic and non-transgenic maize and switchgrass events. The glucan and xylan content from a set of transgenic plants, whether expressing a single or multiple CWD enzymes or lacking a transgene encoding a CWD enzyme (transgenic control TGC), are similar to wild-type control plants (A×B).

TABLE 2

Glucan and xylan content of transgenic plants (CWD expressing or TGC) versus non-transgenic wild-type (A × B) plants.

| Plant Stover | # events (n) | Glucan (g/100 g stover) | Xylan (g/100 g stover) |
|---|---|---|---|
| Wild type maize controls | 4 | 31.51 ± 0.33 | 17.12 ± 0.66 |
| Transgenic maize controls | 8 | 30.16 ± 1.02 | 15.99 ± 1.14 |
| Transgenic maize with enzymes | 18 | 31.40 ± 1.52 | 16.59 ± 1.34 |

A Student t-test of the data presented in Table 2 shows no significant difference in the amount of glucan between transgenic maize events expressing CWD enzymes and wild-type maize A×B, or between transgenic maize events expressing CWD enzymes and transgenic control events that do not express a CWD enzyme with a P-value of 0.90 and 0.14, respectively. The corresponding P-values from a t-test on xylan content are 0.57 and 0.36, respectively.

Therefore, in planta expression of enzymes provides an opportunity for producing not only low cost enzymes but also biomass feedstocks with hydrolytic traits for cheap fermentable sugar production.

Example 3

Effect of Plant Expressed CWD Enzymes on Biomass Hydrolysis

Methodology for Plant Biomass Hydrolysis Evaluation

One of the goals of expressing CDW enzymes in planta is to eliminate or reduce the severity of chemical pretreatment conditions for processing lignocellulosic biomass.

To evaluate the effects of plant expressed CWD enzymes on biomass hydrolysis, a consolidated process with moderate chemical pretreatment (pH 5.0-9.0, 55° C. for 16 hours) followed by an enzymatic hydrolysis (pH 4.9, 50° C. for 72 hours) without inter-stage washing was developed and chosen as a standard procedure for the initial plant stover screening. In this process, in-house enzyme cocktails (cocktail #1 and cocktail #5) were used for the evaluation. The in-house cocktail is a combination of individual enzyme components, which enables the omission of any component depending on the identity of the enzyme(s) expressed in planta. For each transgenic plant stover and wild type or transgenic control plant stover, the following treatments for enzymatic hydrolysis were run in parallel: no enzyme cocktail (NCt), full cocktail (FCt), and cocktail lacking the in planta expressed enzyme (Ct-PE; e.g., cocktail lacking xylanase (Ct-Xyn), cocktail lacking endoglucanase (Ct-EG), or cocktail lacking both xylanase and endoglucanase (Ct-Xyn-EG)).

To determine which enzyme or enzymes support good hydrolysis performance, two criteria were used to evaluate the processing characteristics of transgenic events expressing CWD enzymes in the initial screening:

1. Total sugar yield from the full cocktail (FCt) hydrolysis (height (1) in FIGS. 2A-2B).

2. Sugar yield difference between hydrolyses involving the full cocktail (FCt) and the enzyme cocktail without the enzyme that is expressed in planta (Ct-PE) (height (2) in FIGS. 2A-2B).

The total sugar produced (height (1)) from processing is a criterion to be considered because it directly affects the yield of final products, the productivity, and operational cost. With the in planta expression of CWD enzymes, it was demonstrated that enzyme-expressing transgenic plants achieved better overall hydrolysis than a control plant under same processing conditions, which was demonstrated from the total glucose and xylose yields in FIG. 2. The second criterion, the sugar yield difference between FCt and Ct-PE (height (2)) represents an effect of plant expressed enzymes on hydrolysis. When using these transgenic plants as biomass feedstocks, it was observed that external enzymes in the enzyme cocktail can be partially or completely replaced by a CWD enzyme or CWD enzymes expressed in transgenic plants, while achieving similar or equal hydrolysis, which is indicated by a smaller change or no difference in sugar yield between FCt and Ct-PE hydrolysis (FIG. 2B).

Plant Stover Hydrolysis Evaluation

Using the two selection criteria identified above, enzymatic hydrolysis of stover samples with the in-house cocktail was done to screen the performance of different transgenic maize plants expressing CWD enzymes. Based on the results of this screening, the best performing transgenic plant events were identified and included xylanase-expressing transgenic plants XynA.2015.05 and XynB.2063.17; endoglucanase-expressing transgenic plants EGA.2049.10 and EGB.2042.03; and transgenic plants expressing multiple enzymes—XynA/AccA/B.2096.01, XynA/AccB.2092.103, EGA/XynA.2242.09, XynB/EGA/CBHA.2345.116, XynB/EGA/CBHB.2349.55 XynB/EGA/CBHB.2349.56, and XynB/EGA/CBHB.2349.229.

Figure 2A:
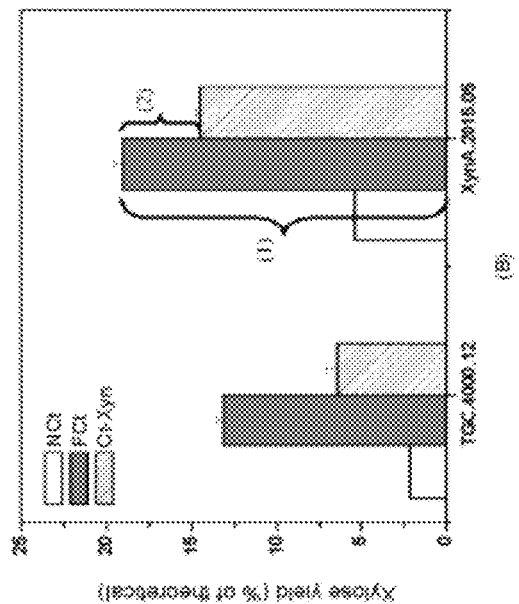
FIGS. 2A-2B illustrate glucose (FIG. 2A) and xylose (FIG. 2B) yields from a pretreated transgenic plant expressing xylanase A (XynA.2015.05) and a transgenic control plant lacking xylanase A (TGC.4000.12) after enzymatic hydrolysis with enzyme cocktail #5 (FCt; gray (middle bar of each set of three)); or the enzyme cocktail #5 lacking xylanase A (Ct-Xyn; diagonal stripes (right)); or no enzymes (NCt; white (left)).
Figure 2B:
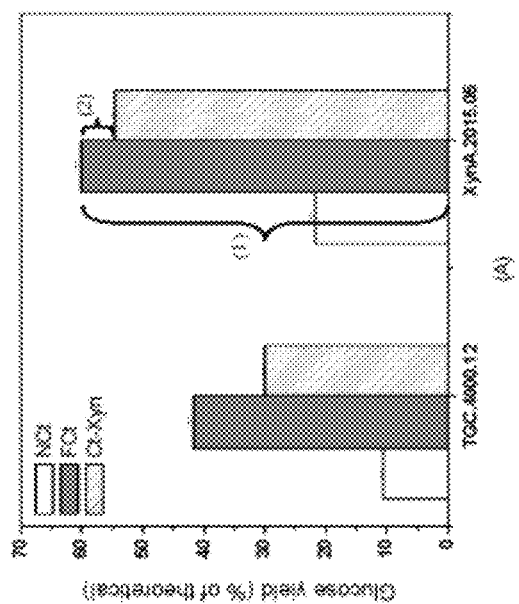

FIG. 2 illustrates glucose (FIG. 2A) and xylose (FIG. 2B) yields after hydrolysis of material from a transgenic plant expressing xylanase A (XynA; XynA.2015.05) and a transgenic control plant TGC.4000.12 that does not express a CWD enzyme (TGC.4000.12). The data on sugar yields from the transgenic event XynA.2015.05 and the transgenic control after enzymatic hydrolysis by FCt (in house cocktail #5), NCt and Ct-Xyn (in house cocktail #5 lacking xylanase A) was evaluated using the above-listed selection criteria. The value of a total glucose yield after FCt treatment (criterion 1) was shown to be higher than the difference in values of glucose yield between FCt and Ct-Xyn treatments (criterion 2) for both XynA.2015.05 and TGC.4000.12. The value of total glucose and xylose yields for all treatments was higher for the transgenic event XynA.2015.05 than for the control plant TGC.4000.12. Interestingly, the difference in glucose and xylose yields after treatments with a full enzyme cocktail and an enzyme cocktail without the plant-expressed xylanase A was very small. Based on these results, xylanase A expressed in a plant was almost as efficient in hydrolyzing the plant stover as xylanase A provided in a full cocktail. Based on the selection criteria 1 and 2, the transgenic event XynA.2015.05 shown in FIG. 2 was identified as a good performer for hydrolysis.

Plants Expressing Xylanase

Xylan is known to be the dominant hemicellulose in hardwood, agricultural residue, biomass, and perennial grasses. Xylan is a heteropolymeric biopolymer that consists of a repeating $\beta$-1,4-linked xylose backbone decorated with branch groups and may be cross-linked to lignin by aromatic esters (Dodd D and Cann I O 2009 Glob Change Biol Bioenergy 1: 2). Xylan destruction and removal benefits the hydrolysis of cellulose into fermentable sugars. In a typical hydrolytic enzyme cocktail, xylanases are a major class of CWD enzymes required to hydrolyze hemicellulose polymers since they play key role in making cellulose more accessible to enzymatic hydrolysis. Referring to FIG. 3B, FIGS. 5B-5D, and FIG. 7B, the transgenic plant events expressing XynA or XynB (XynB.2063.17, XynA/Acc/A/B.2096.01, and XynA.2015.05T1) demonstrated 29.80-172.1% higher xylan conversion from Ct-Xyn hydrolysis than the control plants, indicating the enhanced effect of in planta expressed xylanase on biomass xylan hydrolysis. Likewise, these transgenic plants also show 50.1-93.5% higher glucan conversion from Ct-Xyn hydrolysis than did the control plants.

Figure 3B:
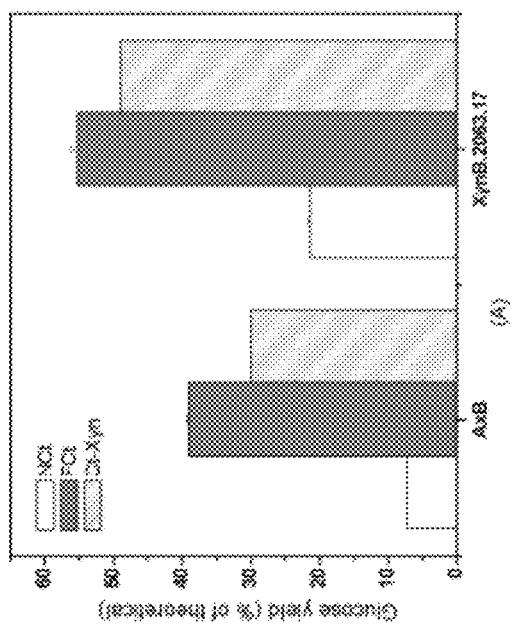
FIGS. 3A-3B illustrate glucose (FIG. 3A) and xylose (FIG. 3B) yields from a pretreated transgenic plant expressing xylanase B (XynB. 2063.17) and a pretreated wild-type control plant (A×B) after enzymatic hydrolysis with enzyme cocktail #1 (FCt; gray (middle)); or the enzymatic cocktail #1 lacking xylanase (Ct-Xyn; diagonal stripes (right)), or no enzymes (NCt; white (left)).
Figure 3A:
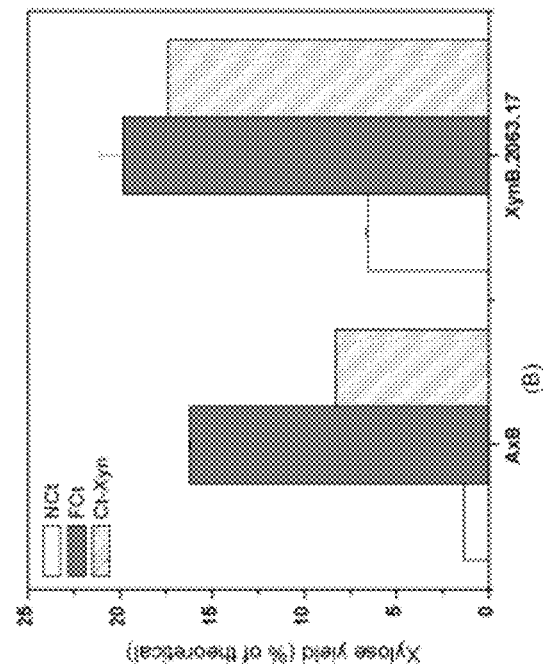

FIGS. 3A-3B illustrate glucose (FIG. 3A) and xylose (FIG. 3B) yields from a pretreated transgenic plant tissue expressing xylanase B (XynB.2063.17) and a wild-type control (A×B) after hydrolysis by the in-house cocktail #1 (FCt), cocktail #1 lacking xylanase B (Ct-Xyn) and no cocktail (NCt). Results for Ct-Xyn treatment demonstrated 63.2% higher glucose yield and 109.4% higher xylose yield from the transgenic event XynB.2063.17 than from the A×B control plant. Improved xylan hydrolysis of the event XynB.2063.17 was also evident from the small difference in values of xylose yield between the FCt and the Ct-Xyn treatments (criterion 2).

These results show surprisingly good performance of xylanase B expressed in planta in hydrolyzing stover in comparison to the enzyme provided in the full cocktail.

Plants Expressing Cellulose

Lignocellulosic biomass is known to be composed of a matrix with multiple intertwined biopolymers (cellulose, hemicelluloses, lignin and extractives), which requires several different classes of enzymes in large quantities to efficiently release fermentable sugars. Among them, cellulase is a key enzyme. Three types of cellulases; endoglucanase, exoglucanase and β-glucosidase, work together to hydrolyze cellulose into glucose. In the hydrolysis process, endoglucanase breaks cross-linkages between cellulose chains while exoglucanase hydrolyzes the individual glucan chains and β-glucosidase breaks down the exoglucanase products to monomers of glucose (Sticklen M B 2008 Nature Reviews Genetics 9:433).

FIGS. 4A-4B show the hydrolysis results for the transgenic plants expressing endoglucanases. These figures illustrate glucose yield from the transgenic events EGA.2049.02 and EGA.2049.10, which express endoglucanase A (EGA), and the transgenic control plant TGC.4000.12, which lacks the enzyme (FIG. 4A). These figures also illustrate glucose yield from the transgenic event EGB.2042.03, which expresses endoglucanase B (EGB), and the transgenic control plant TGC.2004.8.02 (FIG. 4B). Hydrolysis treatments were with the full enzyme cocktail #1 (FCt), enzyme cocktail lacking endoglucanase (Ct-EG) and no enzymes (NCt). For EGA-expressing maize events, both EGA.2049.02 and EGA.2049.10 achieved 48.9-126.9% higher glucan conversion compared to the transgenic control plant (TGC.4000.12) (FIG. 4A). The difference in glucose yields between Ct-EG and FCt hydrolysis is negligible for EGA.2049.10, and about 29.1% lower for TGC.4000.12. Similar observations based on criterion 2 were made for the transgenic event EGA.2049.02. Referring to FIG. 4B, the EGB expressing transgenic plant EGB.2042.0) shows 63.6% higher glucan conversion from Ct-EG hydrolysis than the transgenic control TGC.2004.8.02. Surprising, the glucose yield from Ct-EG hydrolysis of EGB.2042.03 is only 12.2% lower than from FCt hydrolysis compared to 23.0% lower value from the corresponding treatments for TGC.2004.8.02. These data show about 50.0% better hydrolysis from the EGB expressing plant than from the control plant.

Plants Expressing Multiple Enzymes

To develop an efficient and inexpensive enzyme production system for rapid and less expensive biomass depolymerization, several enzymes used in the hydrolytic enzyme cocktail were expressed in maize.

FIGS. 5A-5D and FIGS. 6A-6B show the results from the hydrolysis of the transgenic plants XynA/AccA/B.2096.05, XynA/AccA/B.2096.01, EGA/XynA.2242.09, XynB/EGA/CBHB.2349.56, XynB/EGA/CBHB.2349.55, and XynB/EGA/CBHA.2345.116, which express multiple enzymes.

Figure 5A:
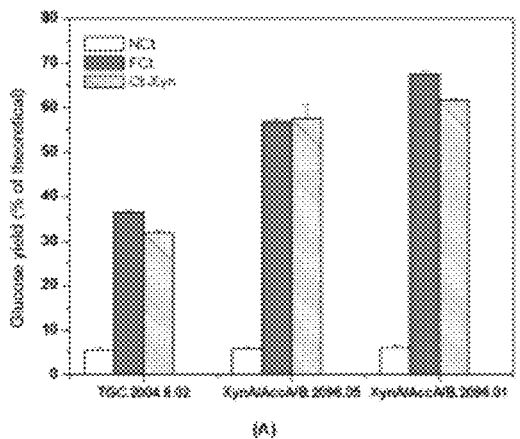
FIGS. 5A-5D illustrate hydrolysis results with transgenic plants expressing multiple proteins.
Figure 5B:
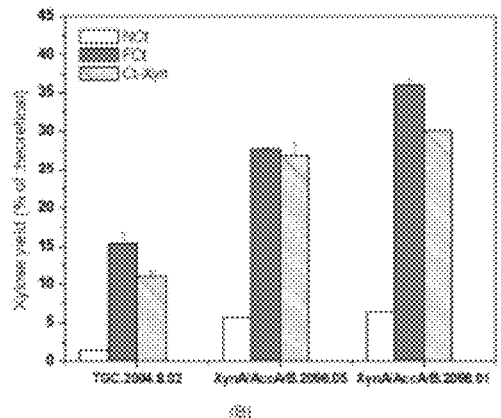

FIGS. 5A-5B illustrate data from enzymatic hydrolysis of the pretreated transgenic maize plants XynA/AccA/B.2096.01, XynA/AccA/B.2096.05 expressing xylanase A (XynA) and accessory enzymes (Acc) and the transgenic control plant TGC.2004.8.02 following the full cocktail #1 (FCt), cocktail #1 without xylanase (Ct-Xyn) and no-cocktail (NCt) treatments. The glucose yield (FIG. 5A) from the Ct-Xyn hydrolysis of the transgenic events XynA/AccA/B.2096.01, XynA/AccA/B.2096.05 is, respectively, 80.4% and 93.5% higher than from the control plant TGC.2004.8.02.

Figure 5C:
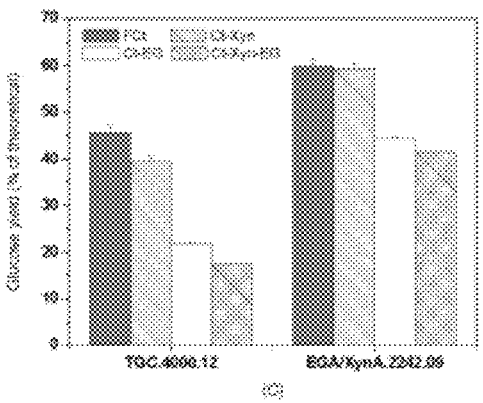
Figure 5D:
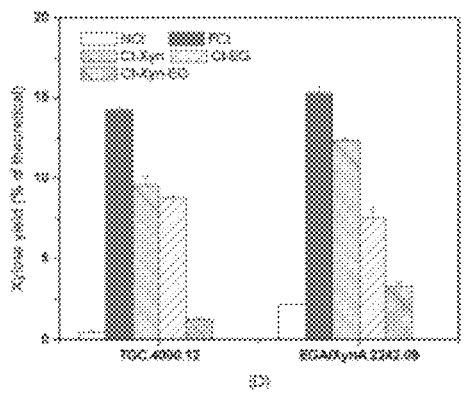

Referring to FIG. 5C, the surprisingly higher glucose yield from Ct-Xyn-EG hydrolysis of EGA/XynA.2242.09 may be explained by a synergistic hydrolytic effect. Likewise, efficiency of xylan conversion based on xylose yield (FIG. 5B) from CT-Xyn hydrolysis of the transgenic tissues from XynA/AccA/B.2096.01, XynA/AccA/B.2096.05 is, respectively, 143.4% and 172.1% higher than that from the control plant TGC.2004.8.02. The observed high efficiency of xylan conversion for these transgenic events may also be attributed to a synergistic effect of multiple enzymes.

FIG. 5 illustrates glucose (FIG. 5C) and xylose (FIG. 5D) yields from the transgenic maize event EGA/XynA.2242.09 simultaneously expressing endoglucanase A (EGA) and xylanase A (XynA) following enzymatic treatments with the full cocktail #1 (FCt), cocktail #1 lacking xylanase (Ct-Xyn), cocktail #1 lacking endoglucanase (Ct-EG] and cocktail #1 lacking xylanase and endoglucanase (Ct-Xyn-EG). The in planta expression of XynA results in the improved glucose and xylose yields for EGA/XynA.2242.09 after hydrolysis. For example, for the Ct-Xyn treatment transgenic events demonstrated 50.1% higher efficiency of glucan conversion (FIG. 5C) and 29.8% higher efficiency of xylan conversion (FIG. 5D) relative to that of the control plant. The in planta expression of EGA results in an improved efficiency of glucan hydrolysis evident from the difference in glucose yields between FCt, Ct-EG, and Ct-Xyn-EG treatments.

Figure 6A:
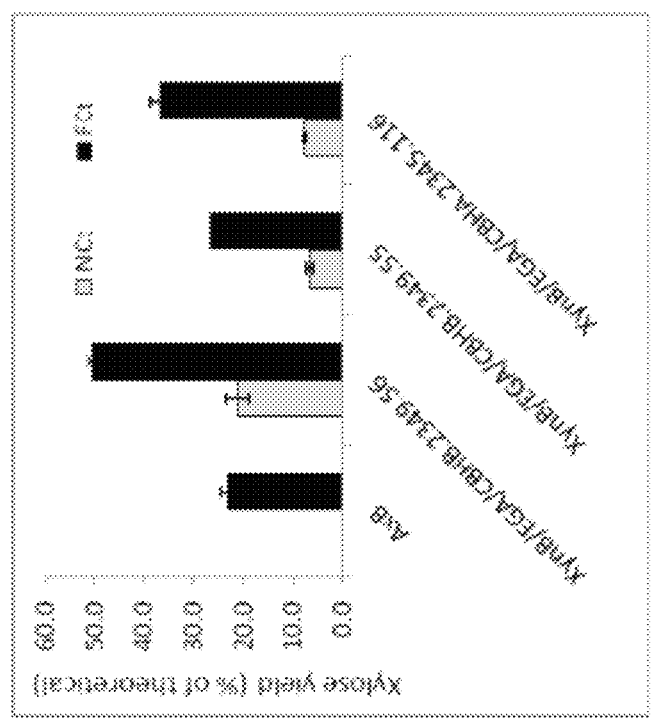
FIGS. 6A-6B illustrate glucose and xylose yields, respectively, from the stover of the pretreated wild type control plant A×B and the transgenic maize plants XynB/EGA/CBHB.2349.56, XynB/EGA/CBHB.2349.55, and XynB/EGA/CBHA.2345.116, which express triple stacked proteins. The yields were measured following enzymatic hydrolysis with the enzyme cocktail Accelerase® 1500/XY (FCt; black bars (right)) compared to a control treatment lacking the enzyme cocktail (NCt; gray bars (left)).
Figure 6B:
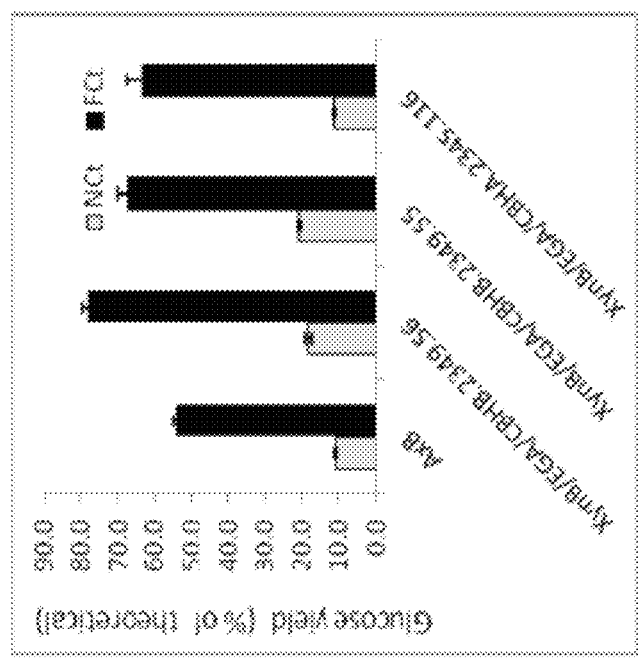

FIGS. 6A-6B illustrate glucose (FIG. 6A) and xylose (FIG. 6B) yields from 1) transgenic events simultaneously expressing three CWD enzymes (XynB/EGA/CBHB.2349.56 and XynB/EGA/CBHB.2349.55, which simultaneously express xylanase B, endoglucanase A (EGA), cellobiohydrolase B, and XynB/EGA/CBHA.2345.116, which simultaneously expresses xylanase B, endoglucanase A (EGA), and cellobiohydrolase A) and 2) wild type control plant A×B. full cocktail (FCt) and no enzyme cocktail (NCt) treatments results are shown. The pretreatment included 0.17 M of ammonium bisulfite and ammonium carbonate (BSC), a liquid to solid ratio equal to 10, at 55° C. for 17 hours. Enzymatic hydrolysis of the stover was performed at 50° C., pH 5.0 for three days using 0.2/0.1 ml of Accellerase® 1500/XY per gram of stover. Referring to FIG. 6, the results show that glucose and xylose yields from the transgenic plants expressing three CWD enzymes were much higher than that from the wild type control plant. Surprisingly, the best performing event XynB/EGA/CBHB.2345.56 showed 43.6% higher in glucose yield and 117.6% higher in xylose yield than that of the negative control (A×B) after a very moderate chemical pretreatment.

Second Generation Plants Expressing CWD Enzymes

The first generation (T0) XynA.2015.05 plant was identified as a good hydrolysis candidate. To further evaluate this event and the corresponding enzyme (XynA) construct, seeds from this event were planted to generate second generation T1 progeny. The hydrolysis evaluation results for T0 and T1 of XynA.2015.05 plants are shown in FIG. 7B.

The two criteria used for assessment of the T0 plants were also applied to evaluate efficiency of hydrolysis for the plants produced in T1 and to demonstrate the enzymes can be effective across species. FIG. 7B shows glucose (FIG. 7A) yields from switchgrass plants made using pAG2015 and xylose (FIG. 7B) yields from the T0 transgenic event XynA.2015.05T0 expressing xylanase A, the T1 transgenic event XynA.2015.05T1 expressing xylanase A and the transgenic control plant lacking the enzyme TGC.4000.11. Hydrolysis was done along with the full cocktail (FCt), cocktail lacking xylanase (Ct-Xyn) and no enzyme cocktail (NCt) treatments. For the Ct-Xyn treatment, the first generation transgenic event XynA.2015.05T1 demonstrated 55.3% higher glucan and 101.6% xylan hydrolysis as judged by glucose and xylose yields similar to that of the first generation event XynA.2015.05T0 and higher than sugar yields for the control plant TGC.4000.12.

These data show that enzymes expressed in planta are heritable and preserve activity in subsequent generations of transgenic plants.

Diverse Plant Species

Figure 8A:
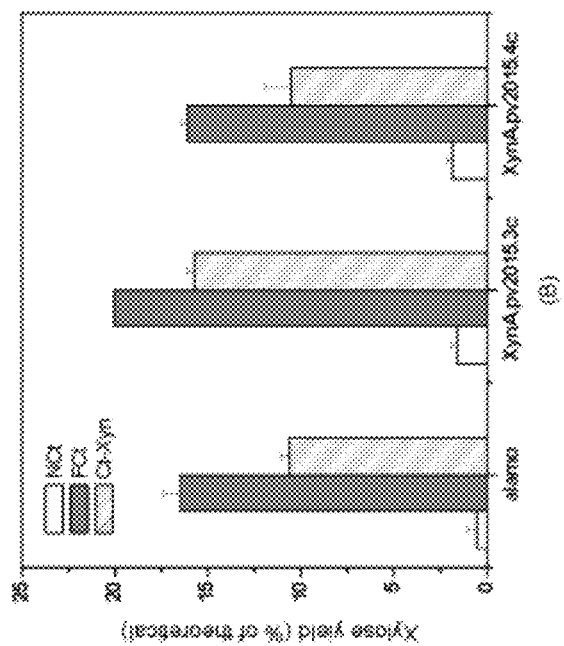
FIGS. 8A-8B illustrate glucose and xylose yields, respectively, from two pretreated transgenic switchgrass plants expressing xylanase A (XynA.pv2015.3c and XynA.pv2015.4c) compared to a control non-transgenic switchgrass plant (Alamo) following enzymatic hydrolysis with enzyme cocktail #1 (FCt; gray (middle)); enzyme cocktail #1 lacking xylanase (Ct-Xyn; diagonal stripes (right)) and a control treatment lacking the enzyme cocktail (NCt; white (left)).
Figure 8B:
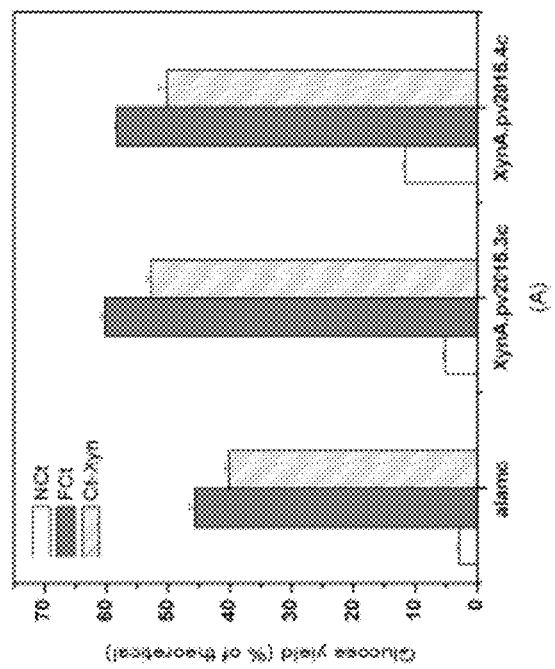

In addition to the transgenic maize events, switchgrass plants expressing xylanase A were obtained through transformation with the vector pAG2015. When xylanase A from a good maize hydrolysis performer XynA.2015.05 was expressed in switchgrass by transformation with the same construct (pAG2015) the resulting transgenic switchgrass XynA.pv2015.3c also demonstrates better glucan and xylan conversion over the control switchgrass Alamo. FIG. 8 illustrates glucose (FIG. 8A) and xylose (FIG. 8B) yields following hydrolysis of the pretreated transgenic switchgrass events XynA.pv2015.3c, XynA.pv2015.4c and the wild type control switchgrass plant (Alamo) in treatments with the full cocktail (FCt), the enzyme cocktail lacking xylanase (Ct-Xyn) and no enzymes (NCT). Both transgenic events XynA.pv2015.3c and XynA.pv2015.4c show better hydrolysis than the control switchgrass (Alamo). The best performing event XynA.pv2015.3c demonstrated about 30.0% higher efficiency in glucan conversion and 50.0% higher efficiency in xylan conversion compared to that of the control plant. These data show that the same hydrolytic trait may be conserved across species expressing enzymes in planta.

Plants Expressing Intein-Modified Enzymes

Figure 9A:
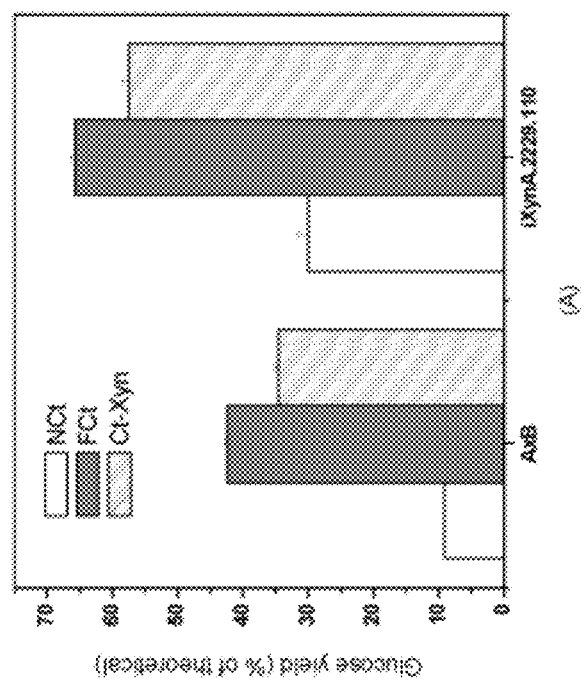
FIGS. 9A-9B illustrate glucose and xylose yields, respectively, from a pretreated transgenic plant (iXynA.2229.110) expressing intein-modified XynA (iXynA) and a pretreated wild-type control plant (A×B) following enzymatic hydrolysis with enzyme cocktail #1 (FCt; gray (middle)); enzyme cocktail #1 lacking xylanase (Ct-Xyn; diagonal stripes (right)) and a control treatment lacking the enzyme cocktail (NCt; white (right)).
Figure 9B:
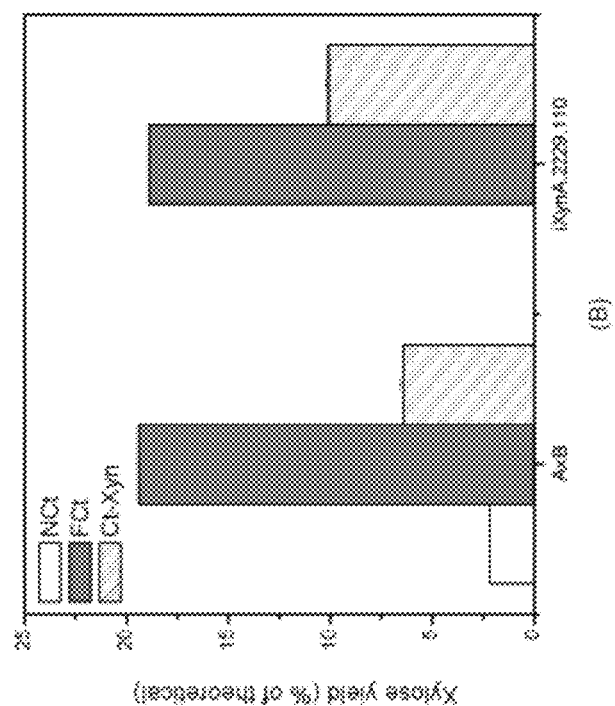

To avoid detrimental effects of in planta accumulation of CWD enzymes on plant growth, intein-modified enzymes were developed and expressed in plants to achieve desirable performance in hydrolysis without causing phenotypical abnormalities in plants. FIG. 9 illustrates glucose (FIG. 9A) and xylose (FIG. 9B) yields following the hydrolysis of a pretreated transgenic plant iXynA.2229.110 expressing intein-modified XynA and a wild type control plant A×B in FCt, Ct-Xyn and NCt treatments. The pretreatment temperature of higher than 50° C. induced intein splicing in iXynA.2229.110. The hydrolysis by Ct-Xyn demonstrates 66.0% higher efficiency of glucan conversion and 57.3% higher efficiency of xylan conversion for iXynA.2229.110 than for the control plant A×B. The transgenic plants iXynA.2229.110 were all normal Data from the carbohydrate compositional analysis showed no significant difference in the amounts of glucan and xylan between the transgenic plants expressing hydrolytic enzyme or enzymes and control plants. Hydrolysis results demonstrated that transgenic plants that express CWD enzymes achieved up to 141% higher glucose yield and 172% higher xylose yield compared the control plants from enzymatic hydrolysis under the experimental conditions.

Example 4

Time Course of Hydrolysis

Figure 10:
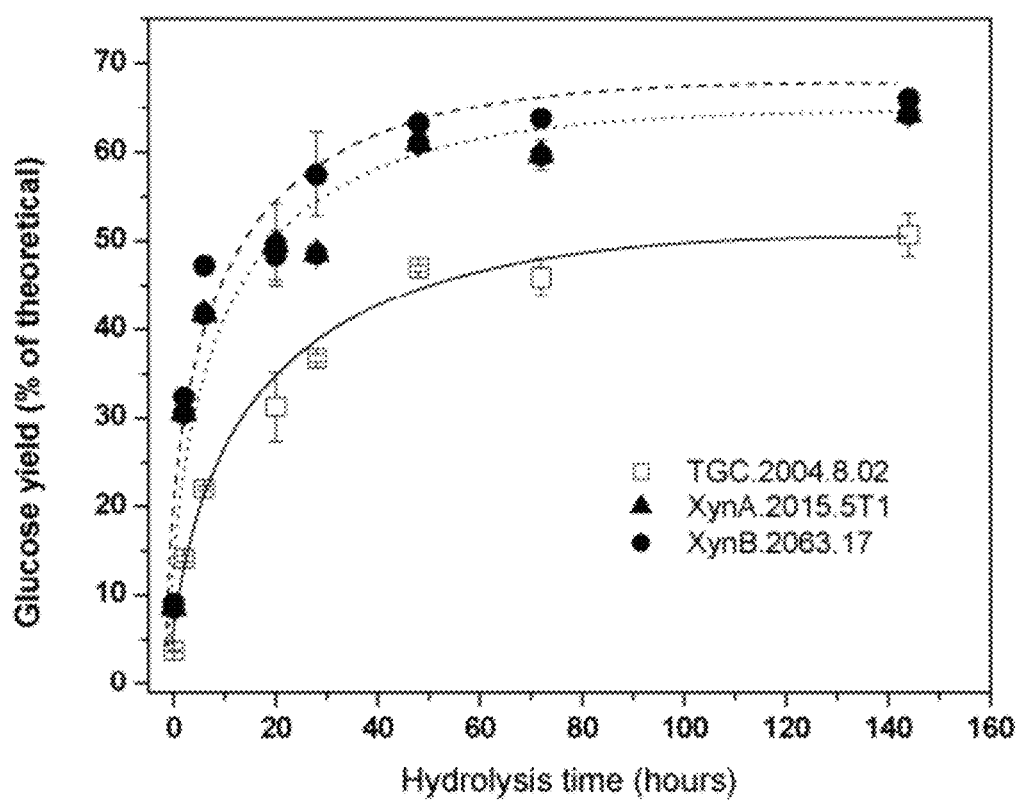
FIG. 10 illustrates the time course of the glucose yield from enzymatic hydrolysis of a pretreated transgenic plant expressing xylanase A (XynA.2015.5T1; closed triangle), and a pretreated transgenic plant expressing xylanase B (Xyn B.2063.17; closed circle) versus a transgenic control plant (TGC.2004.8.02; open square) using enzyme cocktail #1.

To better evaluate the effect of in planta expressed enzymes on hydrolysis, a time course assessment of hydrolysis for candidate transgenic plants was conducted. FIG. 10 compares the time courses for full cocktail (FCt) hydrolysis of a transgenic plant XynB, 2063.17, XynA.2015.05T1 and the control plant TGC.2004.8.02. The kinetics of hydrolysis follows a typical profile: a rapid initial hydrolysis is followed by a slow rising phase and a final plateau. The hydrolysis slows down at 24 hours and levels out after 48 hours. The transgenic plants expressing xylanases in planta demonstrate consistently better hydrolysis than the control plant through the time course, as evident from 30.0-40.0% higher glucose yields for a 3-day hydrolysis. Xylanase expression in planta can be considered as an enzyme pretreatment to improve both biomass hemicellulose and cellulose hydrolysis.

Figure 11:
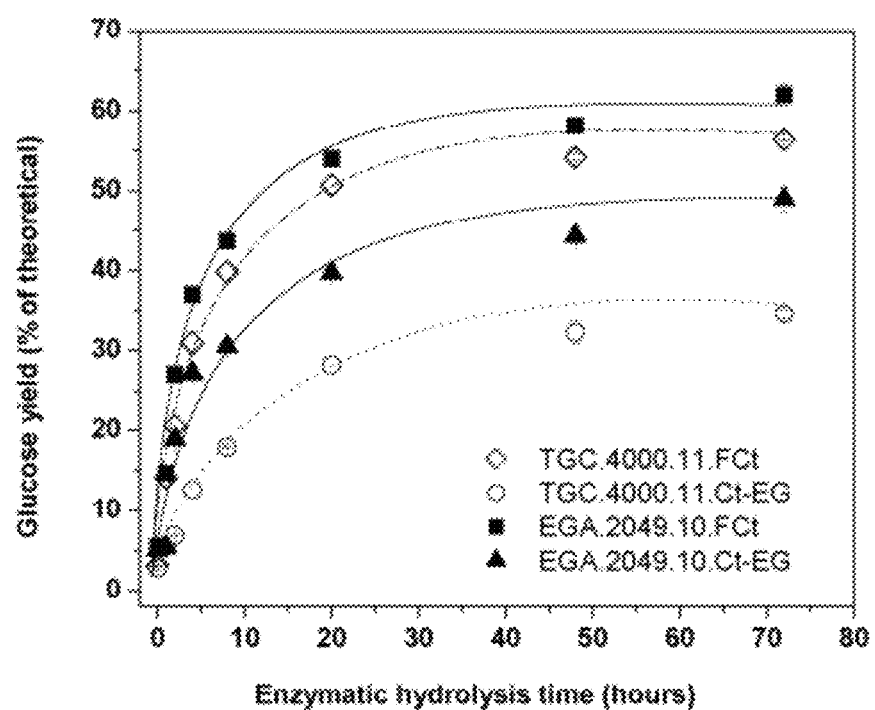
FIG. 11 illustrates the time course of glucose yield from enzymatic hydrolysis of a pretreated transgenic plant (EGA.2049.10) and a pretreated transgenic control (TGC.4000.11) using enzyme cocktail #1 (EGA.2049.10.FCt, closed square; TGC.4000.11.FCt, open diamond) and the enzyme cocktail #1 lacking endoglucanase (EGA.2049.10.Ct-EG, closed triangle; TGC.4000.11.Ct-EG, open circle).

FIG. 11 illustrates the time course of enzymatic hydrolysis of the transgenic plant EGA.2049.10 expressing endoglucanase A (EGA) compared to a transgenic control plant TGC.4000.11 using FCt and Ct-EG. The effect of in planta expressed endoglucanase A on hydrolysis was demonstrated by the difference in glucose yields from these plants throughout the time course of Ct-EG hydrolysis. Throughout the time course, the endoglucanase-expressing plants EGA.2049.10 demonstrated 48.9% and 63.6% consistently higher glucan conversion from Ct-EG hydrolysis than did the control plants TGC.4000.11. Surprisingly, a more efficient and faster hydrolysis has been achieved from the transgenic plants with endoglucanase expression.

Figure 12A:
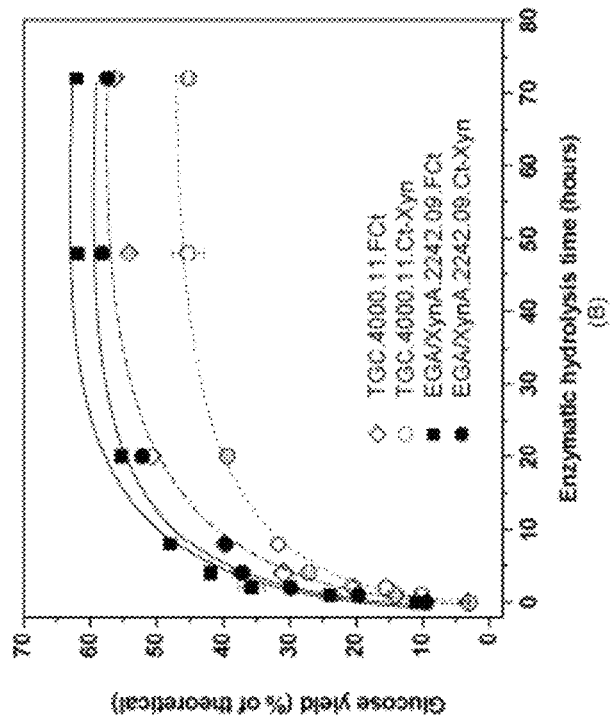
FIGS. 12A-12B illustrate time courses of the glucose yield from enzymatic hydrolysis of a pretreated transgenic plant (EGA/XynA.2242.09) and a pretreated transgenic control plant (TGC.4000.11) using the full enzyme cocktail (EGA/XynA.2242.09.FCt, closed square; TGC.4000.11.FCt, open diamond) compared to treatments using the full enzyme cocktail lacking endoglucanase (EGA/XynA.2242.09.Ct-EG, closed circle; TGC.4000.11.Ct-EG, open circle in FIG. 12A) and the full enzyme cocktail lacking xylanase (EGA/XynA.2242.09.Ct-Xyn, closed circle; TGC.4000.11.Ct-Xyn, open circle).
Figure 12B:
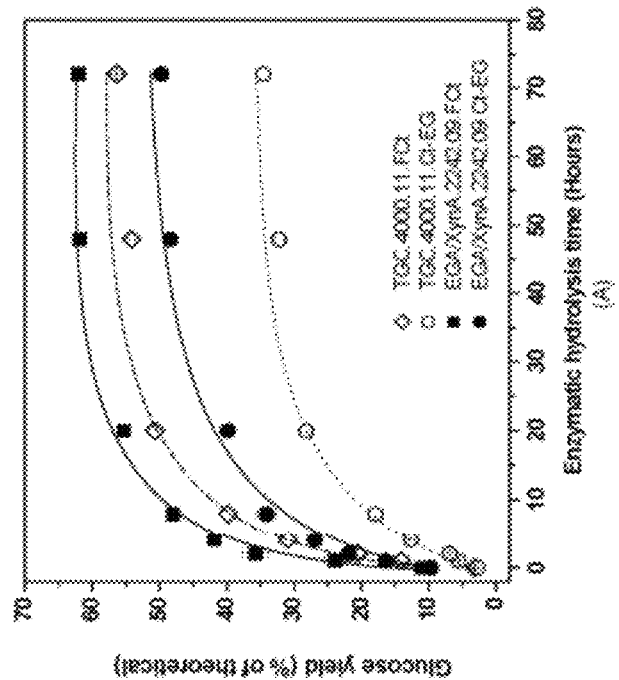

FIG. 12 illustrates the time course of enzymatic hydrolysis of the transgenic event EGA/XynA.2242.09 expressing EGA and XynA and the transgenic control plant TGC.4000.11. The transgenic event EGA/XynA.2242.09 demonstrates consistently higher glucose yields (FIG. 12A) and xylose yields (FIG. 12B) using FCt, Ct-EG and Ct-Xyn compared to that of the control plant TGC.4000.11. The data demonstrate that these high sugar yields result from the simultaneous expression of endoglucanase and xylanase in plants.

Figure 13A:
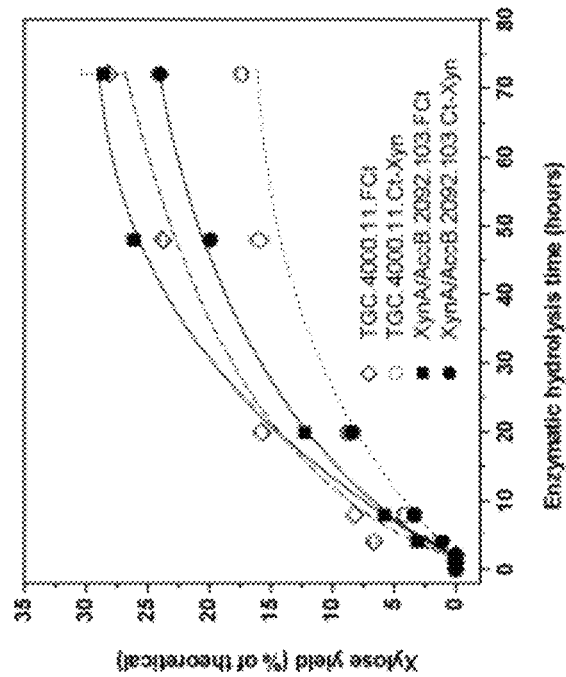
FIGS. 13A-13B illustrate time courses of glucose and xylose yields, respectively, from a pretreated transgenic plant expressing xylanase A and feruloyl esterase B (XynA/AccB.2092.103) and a pretreated transgenic control plant (TGC.4000.11) following enzymatic hydrolysis with the full enzyme cocktail (XynA/AccB.2092.103.FCt, closed square; TGC.4000.11.FCt, open diamond) and the full enzyme cocktail lacking xylanase (XynA/AccB.2092.103.Ct-Xyn, closed triangle; TGC.4000.11.Ct-Xyn, open circle).
Figure 13B:
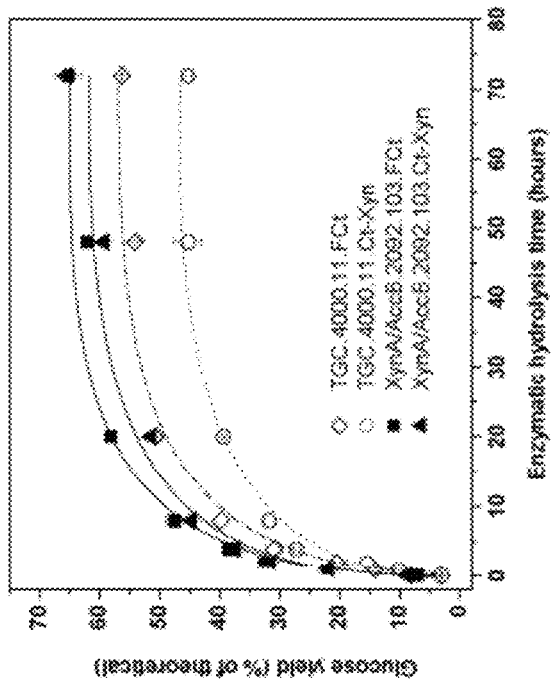

FIG. 13 illustrates the time course of the enzymatic hydrolysis of the transgenic plant XynA/AccB.2092.103 expressing XynA and an accessory enzyme (*Aspergillus niger* FAE B) and the transgenic control plant TGC.4000.11 using FCt and Ct-Xyn treatments. The Ct-Xyn hydrolysis of the pretreated stover from the transgenic plant XynA/AccB.2092.103 achieved more than 30% higher efficiency in glucan conversion (FIG. 13A) and more than 24% higher efficiency in xylan conversion (FIG. 13B) than a transgenic control plant throughout the time course.

Referring to FIG. 12 and FIG. 13, the better hydrolysis of transgenic plants that express multiple enzymes was also observed in terms of glucose and xylose yields throughout the time course of hydrolysis of XynA/AccB.2092.103 and EGA/XynA.2242.09. The better hydrolysis may be explained by a synergistic effect of the action of multiple enzymes.

Referring to FIGS. 10, 11, 12A and 13A, the results show that in addition to the higher hydrolysis yields achieved through expression of CWD enzymes in plants, the kinetics profiles of the transgenic events expressing CWD enzymes during the time course of hydrolysis show a higher initial slope in the change of glucose yields compared to that of control plants indicating a faster initial hydrolysis.

Referring to FIG. 10, in addition to the better hydrolysis, the transgenic plants expressing hydrolytic enzymes also show faster initial hydrolysis than do the control plant (FIG. 10). After in planta expression, the hydrolytic enzymes have been accumulated within plant cells. During processing, they can start to function immediately in situ without the need for long distance transport and diffusion. The efficiency of these enzymes is therefore expected to be high because of low resistance from mass transfer and an expected decrease in non-selective binding of the in planta enzymes to lignin or other non-target molecules. The over expression of plant biomass degrading enzymes in plants does not appear to result in a decrease in cellulose, but rather loosened xyloglucan intercalation, followed by an irreversible wall modification. All these factors may contribute to the faster hydrolysis for enzyme expressed plants.

Example 5

Hydrolysis Improvements by Increasing Pretreatment Temperature

Figure 14:
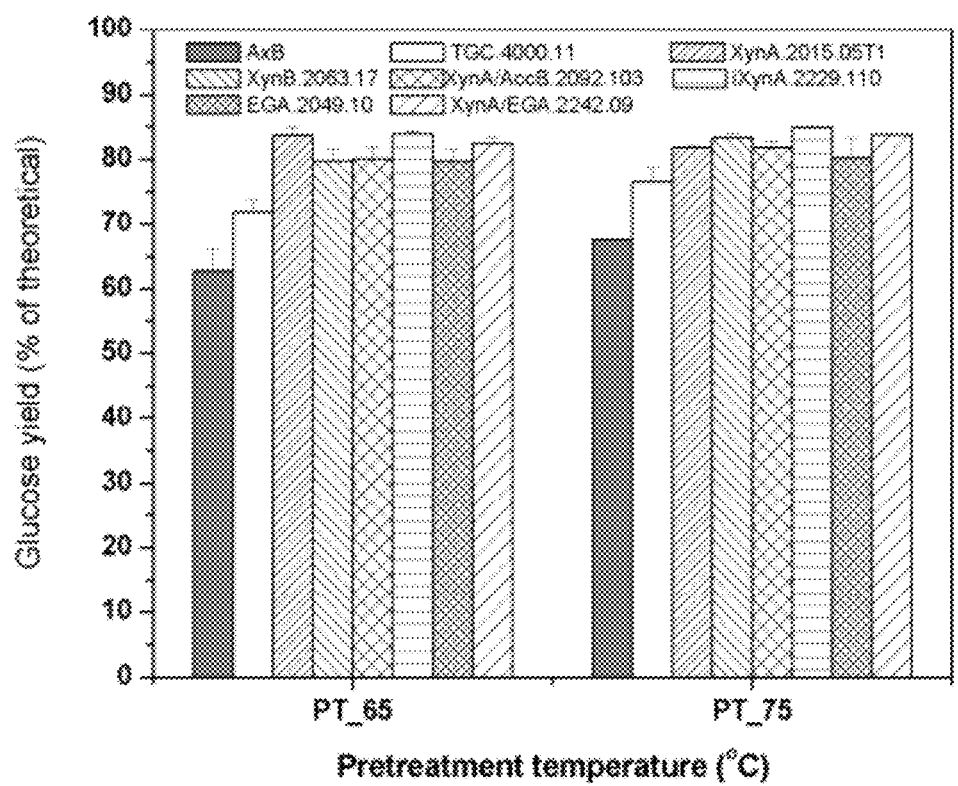
FIG. 14 illustrates glucose yields from enzymatic hydrolysis of pretreated transgenic plant expressing the following proteins: xylanase B (XynB.2063.17), endoglucanase (EGA.2049.10), xylanase A and feruloyl esterase B (XynA/Acc.B.2092.103), xylanase A and endoglucanase (EGA/XynA.2242.09), intein modified xylanase A (iXynA.2229.110) compared to a non-transgenic control plant (A×B) and a transgenic control plant lacking enzymes (TGC.4000.11). Pretreatments were performed at temperatures of 65° C. (PT_65) and 75° C. (PT_75). Enzyme loading includes 0.2 ml Accellerase® 1500 or 0.1 ml Accellerase® XY per gram of biomass and 0.05 µM β-glucosidase (BGL). The bars above each of the PT_65 and PT_75 pretreatment sets present data for the transgenic and control plants from left to right as follows: A×B; TGC.4000.11; XynA.2015.05T1; XynB.2063.17; XynA/AccB.2092.103; iXynA.2229.110; EGA.2049.10; and XynA/EGA.2242.09.

With the pretreatment chemicals, a relative high temperature for pretreatment typically delivers more pretreatment effects on hydrolysis. To examine the effect of pretreatment temperature, the top hydrolysis performers identified were subject to pretreatments at 65° C. and 75° C. The glucose hydrolysis yields of these plants are shown in FIG. 14.

It has been found that the thermal stability of some CWD enzymes including endoglucanase A (O77044) may improve when expressed in plants. Thermal stability of highly thermostable enzymes such as a family 12 endoglucanase C (O33897) can be further improved after expressing in plants, providing opportunities to apply elevated pretreatment temperatures during processing to achieve improved hydrolysis. FIG. 14 illustrates the effect of a pretreatment temperatures on glucose yield from the top performing transgenic events XynB.2063 (expressing xylanase B), XynA.2015.05T1 (expressing xylanase A), EGA.2049.10 (expressing endoglucanase A), XynA/AccB.2092.103 (expressing xylanase A and accessory enzyme B), XynA/EGA.2242.09 (expressing xylanase A and endoglucanase A), and iXynA.2229.110 (expressing an intein-modified xylanase A) versus the wild type control plant A×B and the transgenic control plant lacking enzyme TGC.4000.11. Hydrolysis of the plants was performed using FCt at a temperature of 65° C. or 75° C. It was demonstrated that increasing a pretreatment temperature from 65° C. to 75° C. improved glucose hydrolysis yields for the control plants A×B and TGC.4000.11 but not for transgenic plants expressing enzymes. This fact may be explained by saturation of the in planta expressed enzymes on available biomass substrate. With a pretreatment temperature of 65° C., all the transgenic plants expressing enzymes showed 11.0-33.4% higher hydrolysis compared to the wild type control plant A×B and the transgenic control TGC.4000.11, reaching 80-84% of theoretical glucose yield.

Figure 15:
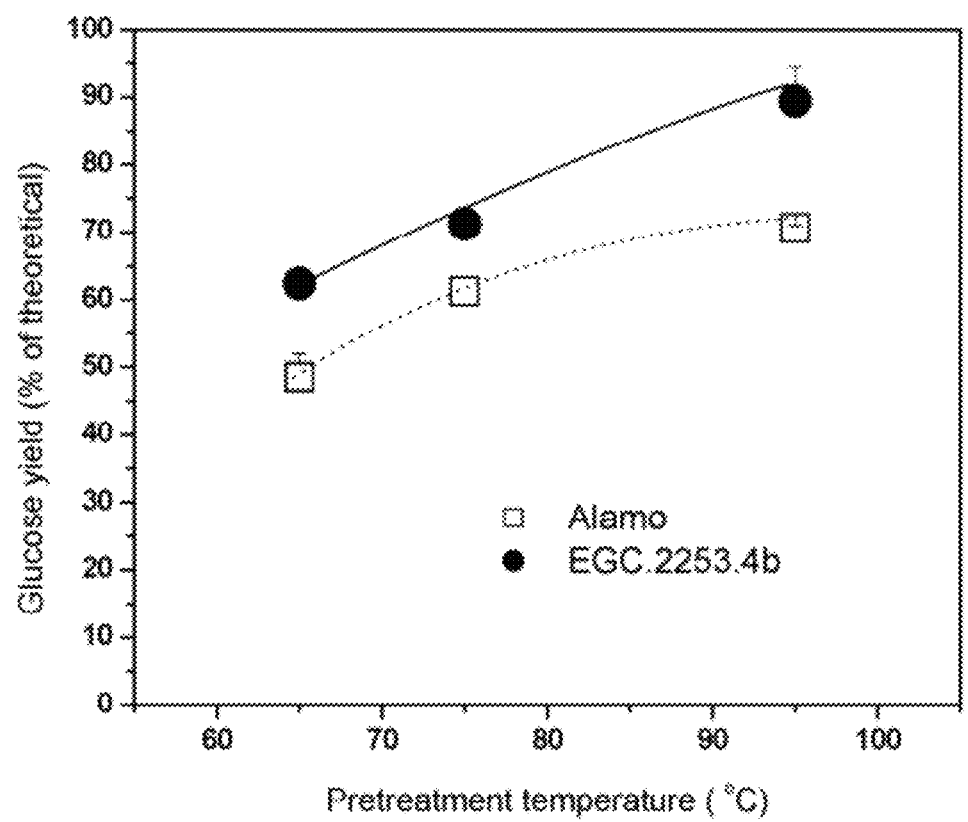
FIG. 15 illustrates glucose yields from enzymatic hydrolysis of pretreated transgenic switchgrass (EGC.2253.4b, closed circle) and a wild type switchgrass (Alamo, open square) with enzyme cocktail #5. Pretreatment temperatures: 65° C., 75° C., and 95° C.

FIG. 15 illustrates the glucose yield from the transgenic switchgrass plant EGC.2253.4b expressing a highly thermostable endoglucanase A (EGC) following pretreatment with temperatures of 65° C., 75° C., and 95° C. and enzymatic hydrolysis. As shown, the glucose yield from the transgenic event EGC.2253.4b was consistently higher than that from the control plant Alamo, reaching 89.4% and 71.4% respective conversion rates of a pretreatment at 95° C.

Figure 16A:
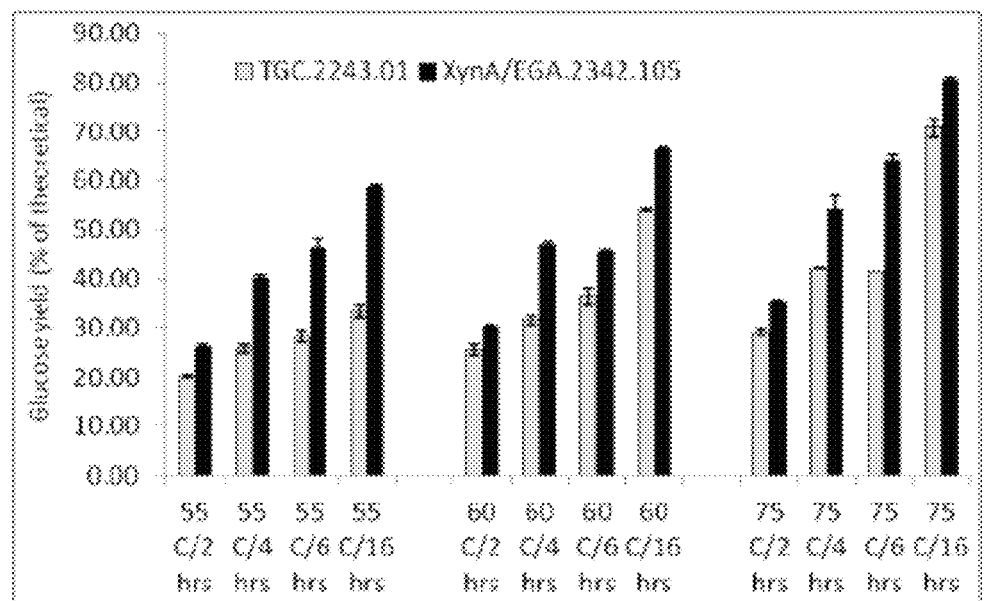
FIGS. 16A-16B illustrate an effect of a pretreatment temperature and time on glucose (FIG. 16A) and xylose (FIG. 16B) yields from enzyme hydrolysis of a pretreated transgenic plant expressing endoglucanase and xylanase A (EGA/XynA.2342.105; black bars (right)) and a pretreated control plant (TGC.2342.01; gray bars (left)).
Figure 16B:
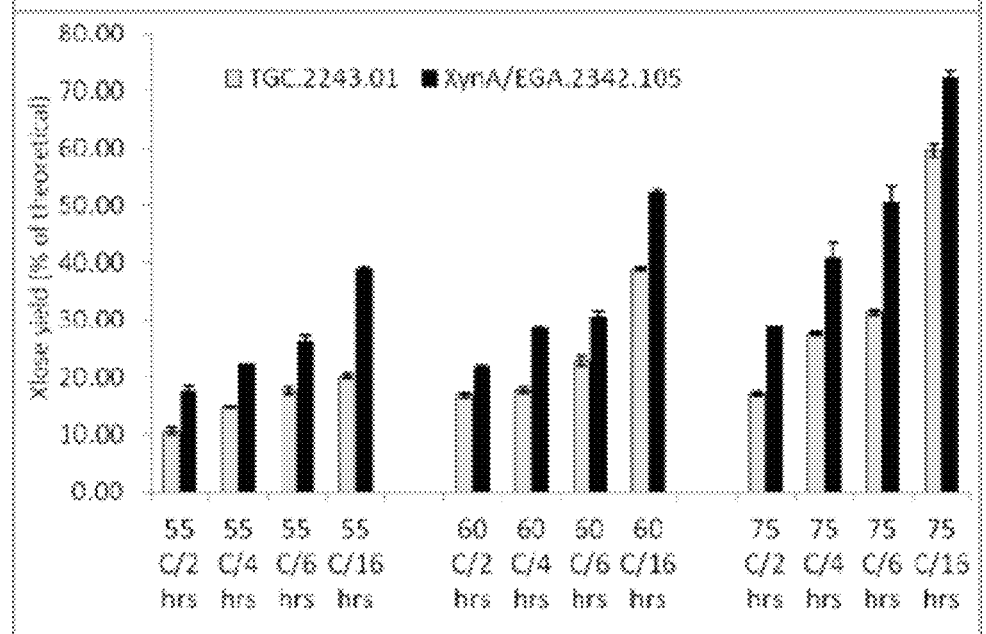

FIGS. 16A-16B illustrate an effect of the pretreatment temperature and time on glucose (FIG. 16A) and xylose (FIG. 16B) yields from the transgenic event XynA/EGA.2342.05 and the transgenic control plant lacking enzymes TGC.2243.01 following enzymatic hydrolysis. Pretreatments were performed using 0.175M ammonium bisulfite and ammonium carbonate at a pH 8.1 and temperatures of 55° C., 60° C. and 75° C. for 2, 4, 6 and 16 hours at each temperature and 3000 rpm. Enzymatic hydrolysis was performed using 0.2 ml Accellerase® 1500/g pretreated stover and 0.1 ml Accellerase® XY/g stover, at 2% solids, pH ~5.0, 1× Britton-Robinson Polybuffer (BR; final pH 4.9), 0.02% sodium azide at 50° C. for 72 hours, at 250 rpm. As shown, for all pretreatment temperatures and periods of time, the transgenic event XynA/EGA.2342.105 expressing xylanase A and endoglucanase A performed consistently better than the control plant TGC.2243.01. These data also show that extending the pretreatment time increases both glucose and xylose yield from plants almost linearly and that pretreatment for 16 hours significantly improves hydrolysis from the transgenic and control plants.

Figure 17A:
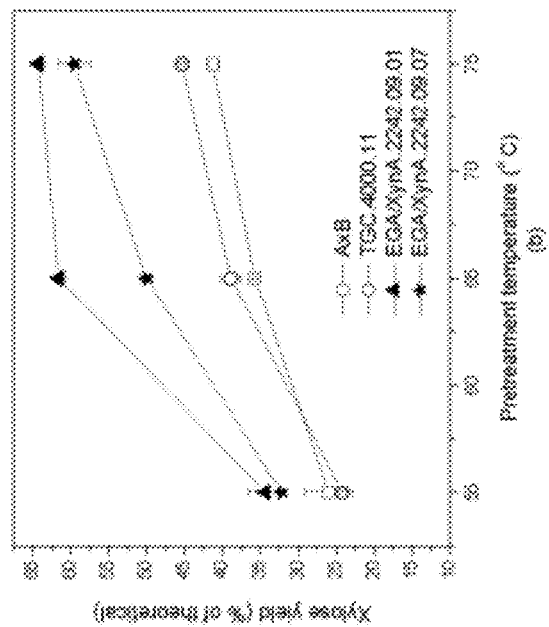
FIGS. 17A-17B illustrate an effect of a pretreatment temperature on glucose (FIG. 17A) and xylose (FIG. 17B) yields from the pretreated transgenic plants EGA/XynA.2242.09.01 and EGA/XynA.2242.09.07 expressing endoglucanase A and xylanase A, and the control plants: wild type A×B and transgenic TGC.4000.11.
Figure 17B:
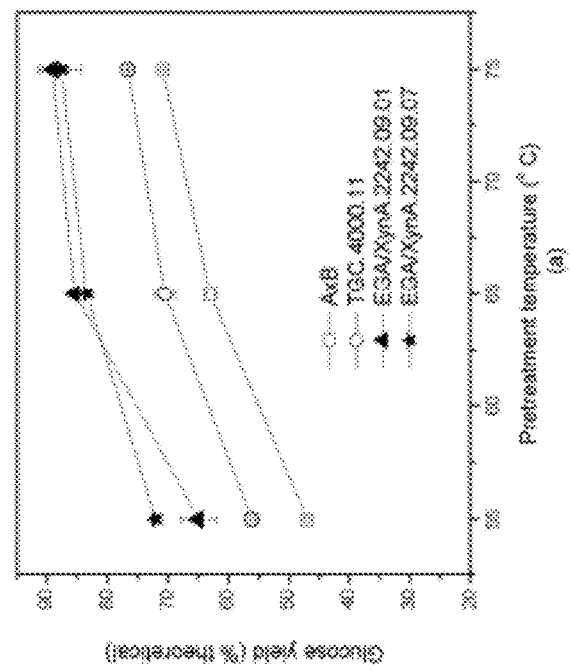

FIGS. 17A-17B illustrate an effect of pretreatment temperature on glucose (FIG. 17A) and xylose (FIG. 17B) yields from the transgenic events XynA/EGA.2242.09.01 and XynA/EGA.2242.09.07 (expressing xylanase A and endoglucanase A) and control plants wild type A×B and transgenic TGC.4000.11. The plants were subjected to enzymatic hydrolysis using full Accellerase enzyme cocktail at temperatures 55° C. to 65° C. and 75° C. Enzyme loadings included 0.2 ml of Accellerase® 1500 per gram of pretreated stover and 0.1 ml Accellerase®XY per gram of pretreated stover. Transgenic plants expressing CWD enzymes achieved up to 83.5-89.1% glucose yield and 50.0-64.3% xylose yield compared to control plants achieved only 63.0-76.6% glucose yield and 35.7-45.3% xylose yield.

Significant hydrolysis can be achieved when increasing pretreatment temperature to 65° C. For some maize stover, increasing temperature to 75° C. improved hydrolysis for the control plants but not for the transgenic plants expressing enzymes. Referring to FIG. 15, for the transgenic switchgrass EGC.2253.4b expressing a highly thermostable endoglucanase C (EGC), the improved hydrolysis was found surprisingly to be significantly higher with increased pretreatment temperature, especially at 95° C. than the for the control plant Alamo.

Overall, pretreating stover from the top performing transgenic plants at elevated temperatures (65° C. and 75° C.) achieved over 80% glucose hydrolysis yields, which is 25% higher hydrolysis compared to control plants that do not express heterologous hydrolytic enzymes. Therefore, in planta expression of highly thermostable hydrolytic enzymes will provide more opportunities to achieve target component hydrolysis.

Example 6

Enzyme Loading Reduction and Fermentability

Figure 18:
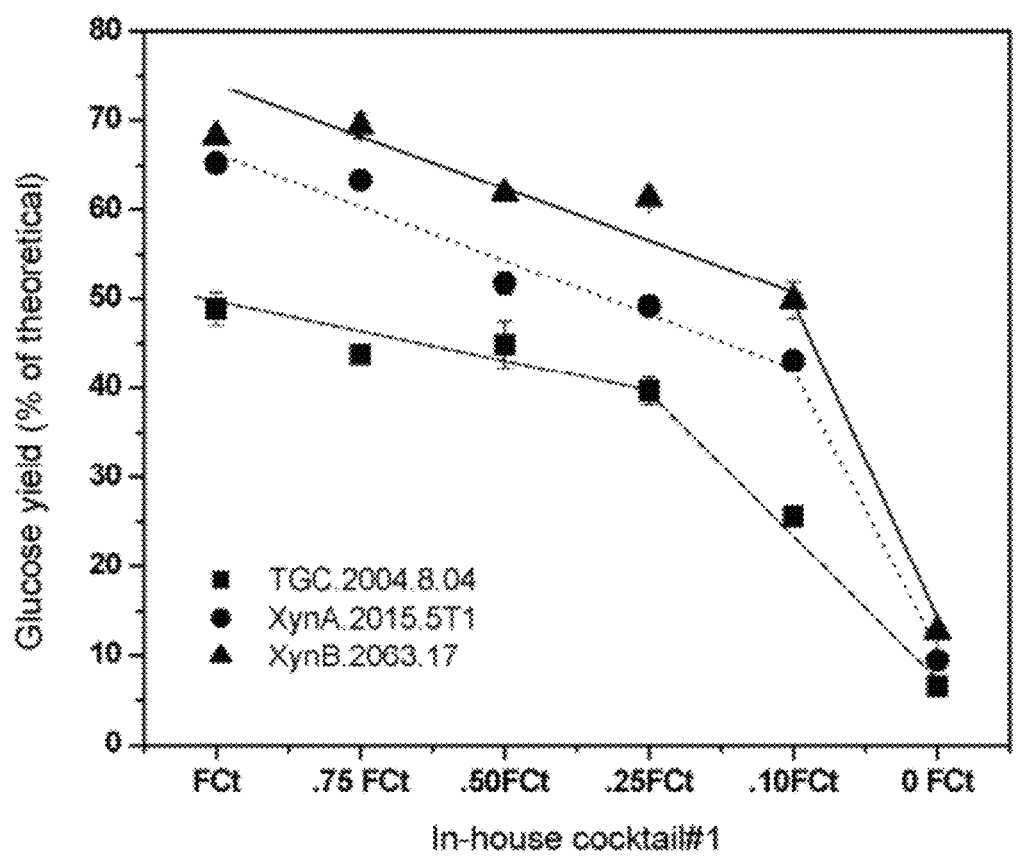
FIG. 18 illustrates an effect of reducing loading of external enzymes on glucose yields from the pretreated transgenic plants XynA.2015.05T1 (closed circle), XynB.2063.17 (closed triangle), and control plant TGC.2004.8.04 (closed square) after hydrolysis with the decreasing enzyme loadings: full cocktail #1 (FCt), 75% full cocktail #1 (0.75 FCt), 50% full cocktail #1 (0.50FCt), 25% full cocktail #1 (0.25FCt), 10% full cocktail #1 (0.10FCt) and no enzymes (0FCt).

Since the transgenic plants expressing CWD enzymes demonstrated higher hydrolysis yields and more rapid kinetics during the hydrolysis compared to the control plants under similar processing conditions, reduction in exogenous enzyme loadings was tested. FIG. 18 illustrates glucose yields from the transgenic plants XynB.2063.17 expressing xylanase B, XynA.2015.5T1 expressing xylanase A and the control plant TGC.2004.8.4 following hydrolysis treatments using the in-house cocktail #1 with varying loadings such as full cocktail (FCt), 75% cocktail (0.75 FCt), 50% cocktail (0.50 FCt). 25% cocktail (0.25 FCt), 10% cocktail (0.10 FCt), and no enzymes (0 FCt). The data demonstrate feasibility in reducing loadings of exogenous enzymes by application of the transgenic material expressing CWD enzymes without reducing sugar yields. For example, the transgenic event XynA.2015.15T1 achieved more than 60% glucan conversion using 0.75 FCt loading which is similar to approximately 65% glucan conversion achieved using FCt loading. In contrast, the transgenic control TGC.2004.8.4 achieved approximately 50.0% glucan conversion using FCt loading and approximately 40% of glucan conversion using 0.75 FCt loading. These data show that hydrolysis of plants expressing CWD enzymes was more efficient than that from control plants and with lower loadings of external enzymes.

Figure 19:
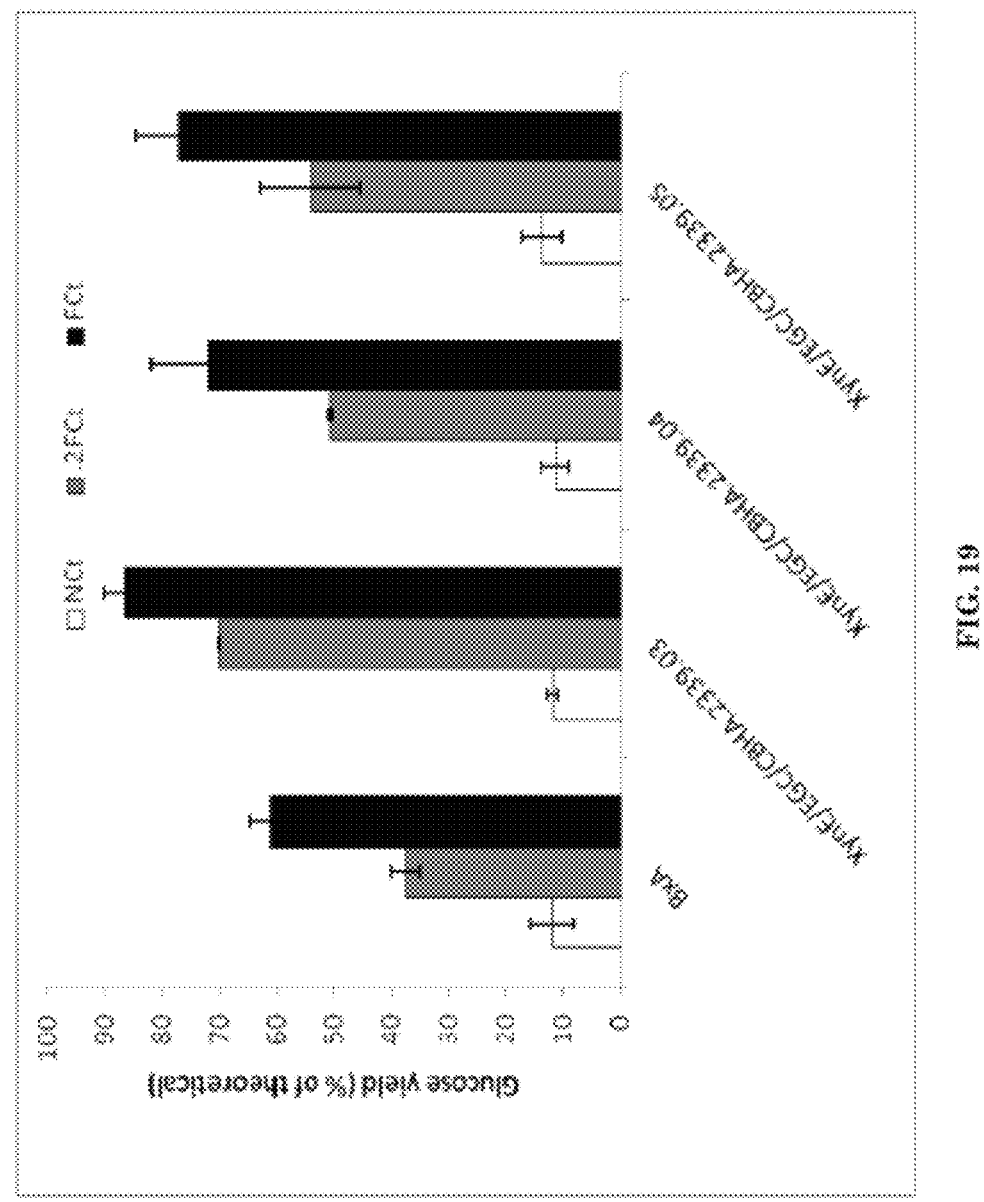
FIG. 19 illustrates an effect of reducing loadings of external enzymes on glucose yields from the transgenic plants XynE/EGC/CBHA.2339.03, XynE/EGC/CBHA.2339.04, and XynE/EGC/CBHA.2339.05, and the control plant B×A. Pretreatment was performed using 0.17 M ammonium bisulfite and ammonium carbonate (pH8.1) at 75° C., at liquid to solid ratio equal to 10 for 16 hours. Enzymatic hydrolysis was conducted at approximately 2% solids content with no enzymes (NCt; white (left)), 20% full cocktail (0.2FCt; gray (middle)) and full cocktail Accellerase®1500/XY at 0.2 ml/0.1 ml of per gram stover (FCt; black (right)) at 50° C. and pH 5.0 for a period of 3 days.

FIG. 19 illustrates glucose yields from the transgenic plants XynE/EGC/CBHA.2339.03, XynE/EGC/CBHA.2339.04, and XynE/EGC/CBHA.2339.05 (expressing xylanase E, endoglucanase C and cellobiohydrolase A) and the wild type control plant B×A following enzymatic hydrolysis with the full cocktail (FCt), 20% full cocktail (0.2 FCt), and no enzymes (NCt) treatments. The data show that 50-70% glucose yield can be achieved from the transgenic plants XynE/EGC/CBHA.2339.03, XynE/EGC/CBHA.2339.04, and XynE/EGC/CBHA.2339.05 using only 20% loadings of the full cocktail which is 35-77% higher than that of the control plants.

Surprisingly, the glucose yield from the transgenic event XynE/EGC/CBHA.2339.03 following hydrolysis with only 20% loading of the full cocktail was still 15% higher than the glucose yield from the control plant B×A after the hydrolysis treatment using the full cocktail.

Figure 20A:
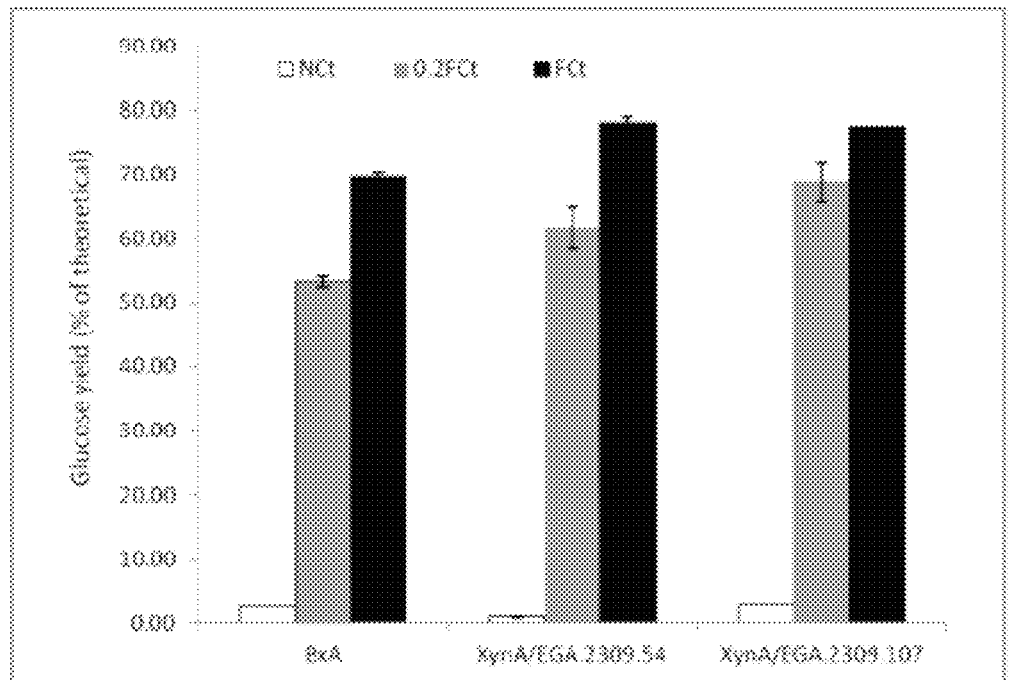
FIGS. 20A-20B illustrate glucose and xylose yields, respectively, from pretreated plants expressing xylanase A and endoglucanase (Xyn A/EGA.2309.54 and XynA/EGA2309.107) compared to a pretreated non-transgenic control plant (B×A) after enzymatic hydrolysis with a full load of the enzyme cocktail Accellerase®1500/XY (FCt; black (right)), a 20% load of the cocktail (0.2FCt; gray (middle in FIG. 20A and right in FIG. 20B)) and no enzymes (NCt; white (left in FIG. 20A)).
Figure 20B:
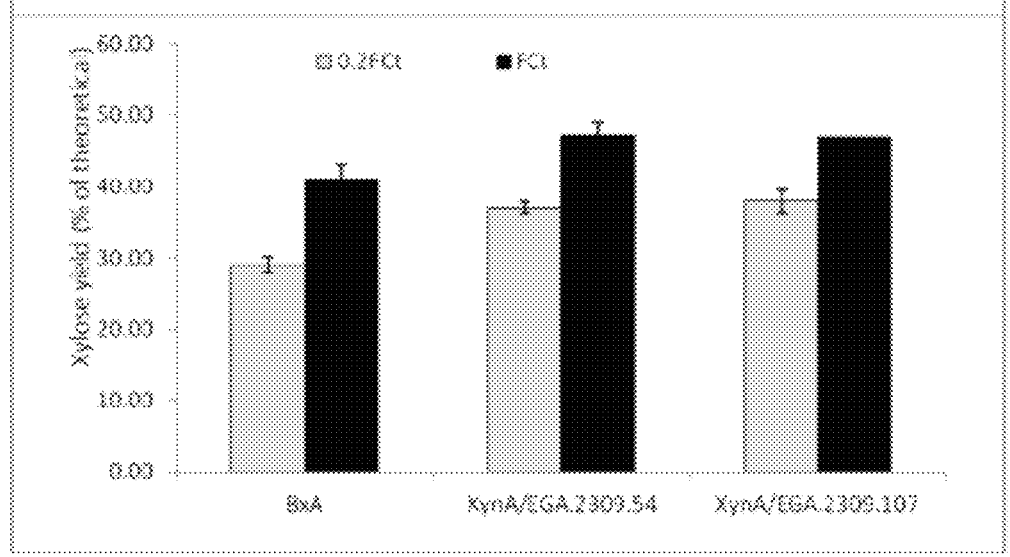

FIGS. 20A-20B illustrate the effect of reduction in loadings of external enzymes on glucose yield from the transgenic events XynA/EGA.2309.54 and XynA/EGA.2309.107 (expressing xylanase A and endoglucanase A) and the control plants B×A after hydrolysis with full cocktail (FCt), 20% full cocktail (0.2FCt) and no enzymes (NCt). 60-70% glucose yields from the transgenic plants expressing enzymes were achieved by using 20% loadings of full cocktails compared to about 80% glucose yields achieved with the full cocktail. In contrast, the negative control plants yielded only 53% glucose in the 0.2 FCt treatment and 70% glucose in the FCt treatment. Referring to FIG. 20B, approximately 38% xylose yields were achieved from the transgenic plants expressing CWD enzymes in 0.2FCt treatment compared to approximately 47% xylose yields in FCt treatment and much lower xylose yields for the negative control plants in both FCt and 0.2FCt treatments. 20% FCt glucose yield of XynA/EGA.2309.54 and XynA/EGA.2309.107 can achieve 16-29.3% higher glucose yield as well as 27.6-31% higher xylose yield than the negative control.

Figure 21A:
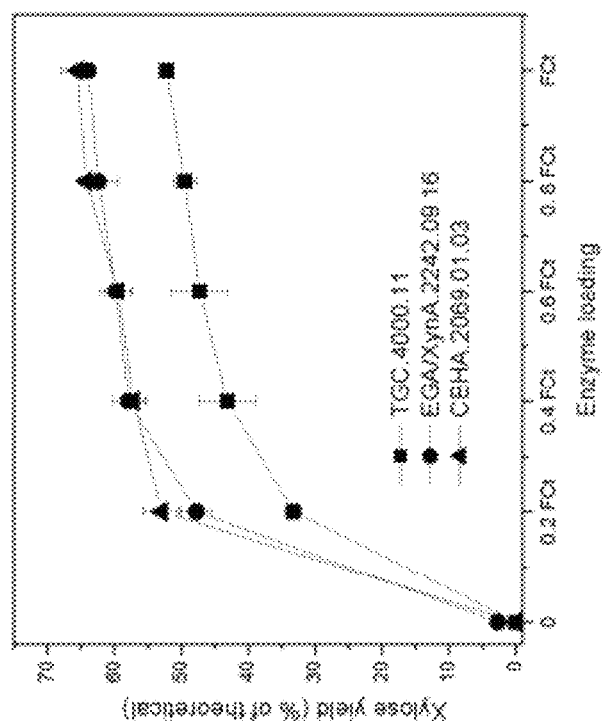
FIGS. 21A-21B illustrate an effect of reducing loadings of external enzymes on glucose (FIG. 21A) and xylose (FIG. 21B) yields from the transgenic plants EGA/XynA.2242.09.16, CBHA.2069.01.03 and the control plant TGC.4000.11 following enzymatic hydrolysis with the full cocktail at 0.2 ml Accellerase® 1500 per gram stover+0.1 ml Accellerase® XY per gram stover (FCt;), 80% full cocktail: 0.16 ml Accellerase® 1500 per gram stover+0.08 ml Accellerase® XY per gram stover (0.8FCt), 60% full cocktail: 0.12 ml Accellerase® 1500 per gram stover+0.06 ml Accellerase® XY per gram stover (0.6FCt), 40% full cocktail: 0.08 mL Accellerase® 1500 per gram stover+0.04 mL Accellerase® XY per gram stover (0.4FCt), 20% full cocktail: 0.04 mL Accellerase® 1500 per gram stover+0.02 mL Accellerase® XY per gram stover (0.2FCt) and no enzymes (0FCt).
Figure 21B:
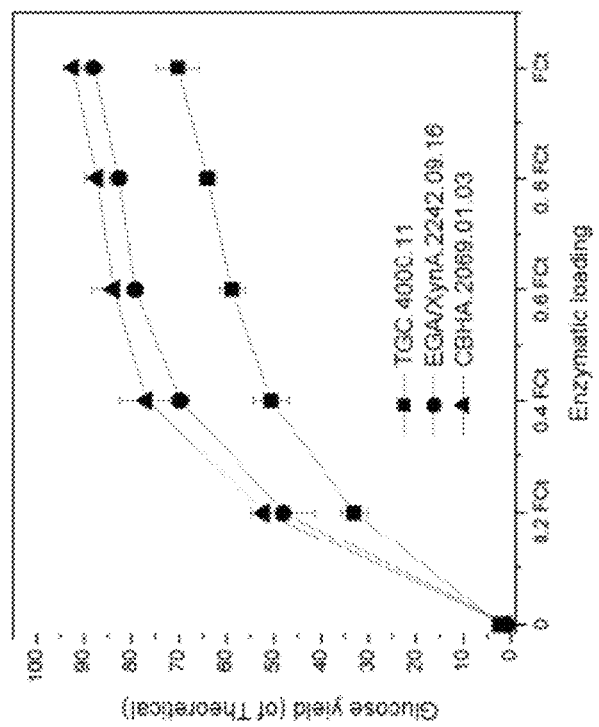

FIGS. 21A-21B illustrate the effect of reduction in external enzyme loadings on glucose (FIG. 21A) and xylose (FIG. 21B) from the transgenic plants EGA/XynA.2242.09.16 (expressing endoglucanase CBHA.2069.1.3) and the transgenic control TGC.4000.11 after hydrolysis using no enzymes (0), 20% full cocktail (0.2FCt), 40% full cocktail (0.4FCt), 60% full cocktail (0.6FCt), 80% full cocktail (0.8FCt), and Full cocktail (Accellerase® 1500/XY). Pretreatment was performed using 0.25 M ammonium bisulfite and ammonium carbonate (pH 8.56) at a liquid to solid ratio equal to 7, at 75° C. for 20 hours. Enzymatic hydrolysis was performed using approximately 2% solids content, pH 5.0, at 50° C. for three days. Surprisingly, the data shows that 60% FCt hydrolysis can achieve 80% of glucose and approximately 60% xylose theoretical yields for both transgenic plants expressing enzymes while only 60% and 49%, respectively, for the negative control TGC.4000.11.

These results demonstrate the potential for reduction in loadings of external enzymes and simultaneously achieving efficient hydrolysis of plant stover by utilizing the transgenic plants expressing CWD enzymes.

Figure 22:
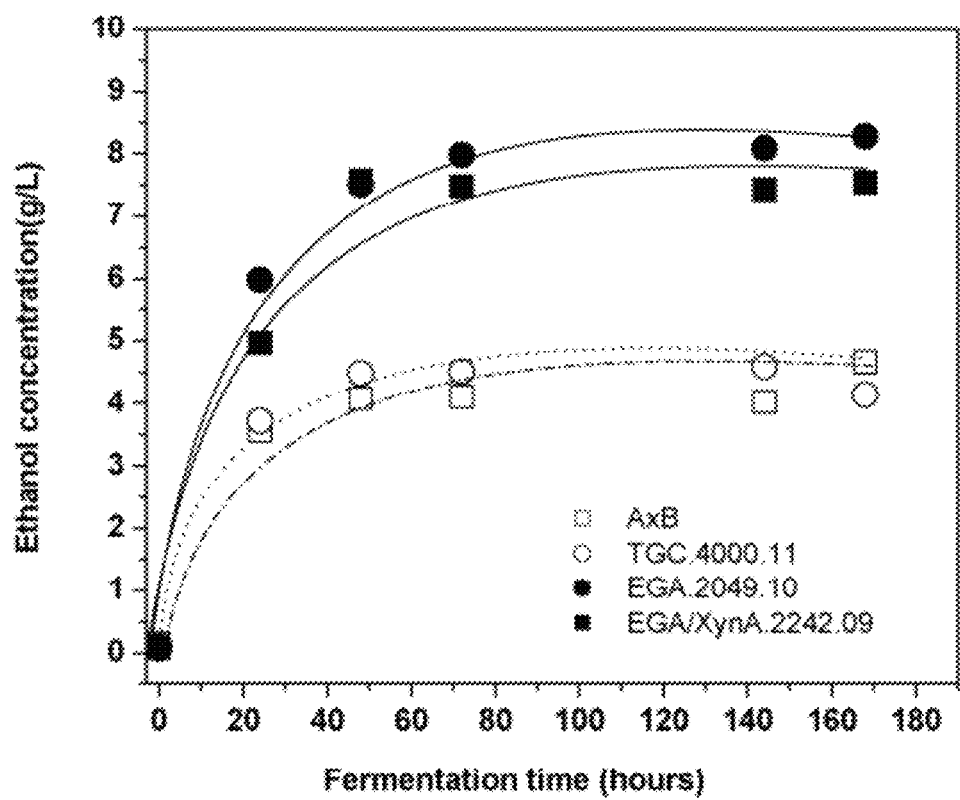
FIG. 22 illustrates ethanol production from simultaneous saccharification and fermentation (SSF) of pretreated transgenic plants EGA.2049.10 and EGA/XynA.2242.09 against control plants using 1) the enzyme cocktails Accellerase® 1500 and Accellerase® XY; and 2) yeast strain *Saccharomyces cerevisiae* D5A.

To evaluate the fermentability of the hydrolysates that are produced from transgenic plants expressing CWD enzymes, a simultaneous saccharification and fermentation (SSF) experiment was performed using *Saccharomyces cerevisiae* D5A. FIG. 22 illustrates the production of ethanol during SSF from the transgenic plants EGA.2049.10 (expressing endoglucanase A) and EGA/XynA.2242.09 (expressing endoglucanase A and xylanase A) and control plants A×B and TGC.4000.11 at a biomass solids content of 6%. These data show about 77.8% higher cellulose conversion was achieved by using the transgenic plants expressing CWD enzymes compared to the control plants. Further, with the moderately pretreated biomass, SSF of the enzyme-expressing plants EGA.2049.10 and EGA/XynA.2242.09 produced ethanol at a concentration of 8.0 g/l, or at 65% ethanol yield, compared to 4.5 g/l, or 42% ethanol yield for the control plants, which corresponds to a 55% improvement in production of ethanol.

The improved hydrolysis has the potential to be translated into the exogenous enzyme loading reduction while still maintaining similar hydrolysis as shown in FIGS. 18-21. Expression of in planta CWD enzymes demonstrated the opportunity to produce low-cost sugar from CWD enzyme-expressing crops or biomass for the production of biofuels, biochemicals, and biomaterials. The benefit of fast initial hydrolysis also provide a potential to achieve similar or better hydrolysis in less operation time, an advantage for a simultaneous saccharification and fermentation process (FIG. 22), and an opportunity to decrease the requirement for equipment capacity and operation cost.

In planta production of cell wall degrading enzymes is a means to lower the costs associated with fermentable sugar production from biomass through the direct hydrolysis of transgenic plants.

Example 7

Thermo-Chemical Effect: Biomass Solubilization from Moderate Pretreatment

Figure 23:
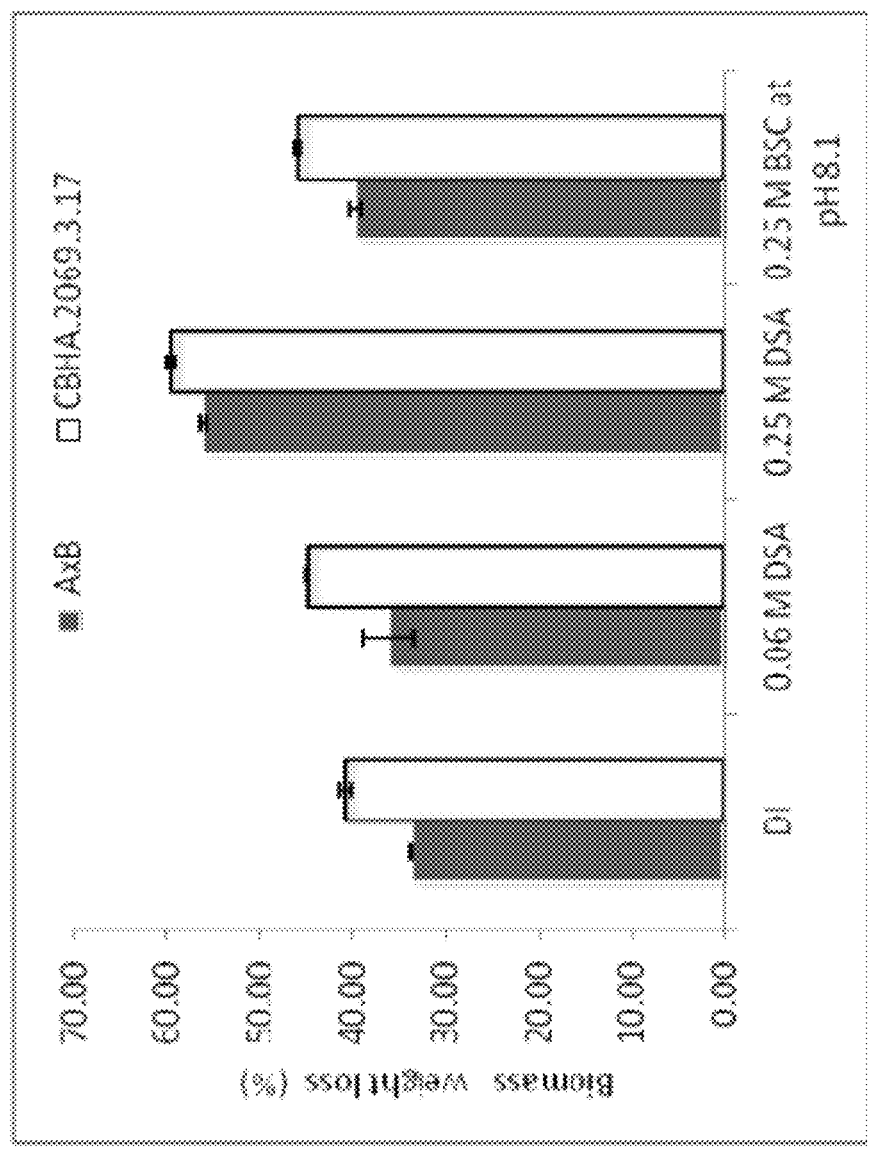
FIG. 23 illustrates biomass solubilization based on weight loss in a transgenic plant expressing exoglucanase CBHA (CBHA.2069.3.17; white) and a wild-type control plant (A×B; gray).

FIG. 23 illustrates biomass solubilization from moderate pretreatment based on weight loss in a transgenic plant expressing exoglucanase CBHA (CBHA.2069.3.17) and wild type control plant (A×B) after pretreatment with deionized water (DI); 0.06M or 0.25M dilute sulfuric acid (DSA); or 0.25 M ammonium bisulfite and 0.23M ammonium carbonate (BSC; pH 8.1 Pretreatment was performed at a temperature of 75° C., a liquid to solids ratio equal to 8, for 16 hours. This figure highlights weight loss data for samples of oven-dried corn stover derived from the transgenic plant and the wild type control plant. Measurements were conducted following wash and centrifugation procedures of the pretreated biomass. Compared to pretreatment with DI, pretreatment with 0.25 M BSC (pH 8.1) results in 17.5% more biomass weight loss for the transgenic plant (CBHA.2069.3.17) and 12.2% more weight loss for the non-transgenic control plant (A×B). The transgenic plant expressing exoglucanase (CBHA.2069.3.17) shows more biomass weight loss from all pretreatments compared to the non-transgenic control plant.

Example 8

Thermo-Chemical Effect: Biomass Weight Loss and Lignin Removal from Moderate Pretreatment Biomass weight loss and lignin removal was determined for samples of oven dried stover derived from a transgenic control plant TGC.2209 after pretreatment with deionized water (DI) and 0.17 M ammonium bisulfite with 0.165M ammonium carbonate (BSC) at pH 8.1, a liquid to solid ratio equal to 8, at a temperature of 75° C., for 16 hours. Measurements were conducted following wash and centrifugation procedures of the pretreated biomass. Table 3 shows that pretreatment with 0.17 M BSC (pH 8.1) results in more biomass weight loss and more lignin removal compared to pretreatment with DI water.

TABLE 3

Biomass weight loss after pretreatment and acid insoluble lignin in pretreated biomass

| Pretreatment chemicals | Biomass weight loss (% of stover) | Acid insoluble lignin (% on pretreated biomass) |
| --- | --- | --- |
| DI water | 34.6 | 10.0 |
| 0.17M BSC | 39.9 | 14.6 |

Example 9

Thermo-Chemical Effect: Deacetylation from Moderate Pretreatment

FIGS. 24A-24B illustrate the effect of the temperature and time on deacetylation of plant biomass assessed for the oven-dried corn stover derived from a transgenic plant expressing cellobiohydrolase A (CBHA.2063.3.17) and a non-transgenic control plant (A×B). The pretreatments included deionized water (DI), 0.06M dilute sulfuric acid (DSA), 0.25 M DSA, or 0.25 M ammonium bisulfite with 0.23M ammonium carbonate (BSC) and were performed at pH 8.1, a liquid-to solid ratio equal to 8, at temperatures 75° C. or 95° C. for 16 hours, or 85° C. for 7 hours. Acetic acid (HAc) concentration was determined by HPLC analysis of the filtrate samples obtained from the pretreated biomass using HPX-87H Column (Bio-Rad Laboratories, Hercules, Calif.) acid column operating at 0.6 ml/min, 60° C. with 0.004 M sulfuric acid as the mobile phase. Pretreatment with 0.25 M BSC (pH 8.1) resulted in significant deacetylation compared to pretreatment with DI water and 0.06 M DSA.

Example 10

Thermo-Chemical Effect: Little/No Sugar Degradation (Furfural and HMF) from Moderate Pretreatment FIGS. 25A-25B illustrate yields of sugar degradation products hydroxymethylfurfural (HMF) and furfural in samples of oven-dried corn stover from a transgenic plant expressing exoglucanase CBHA (CBHA.2069.3.17) and a non-transgenic control plant (A×B) after pretreatment with deionized water (DI), 0.06M dilute sulfuric acid (DSA), 0.25 DSA, or 0.25 M ammonium bisulfite and 0.23M ammonium carbonate (BSC; pH 8.1). Pretreatment was performed at temperatures 75° C. and 95° C. for 16 hours and 85° C. for 7 hours. Concentrations of HMF and furfural in the filtrate of the pretreated biomass were measured by HPLC analysis using HPX-87H Column (Bio-Rad Laboratories, Hercules, Calif.) acid column operating at 0.6 ml/min, 60° C. with 0.004 M sulfuric acid as the mobile phase.

The data show that little to no HMF or furfural were found in samples from a transgenic plant expressing exoglucanase CBHA (CBHA.2069.3.17), or the non-transgenic control plant (A×B) after pretreatment with 0.25 M BSC (pH 8.1) in comparison to pretreatment with deionized water (DI), 0.06 M dilute sulfuric acid (DSA), or 0.25 M DSA, which led to sugar degradation and detection of HMF and furfural in samples.

Example 11

Autohydrolysis from in Planta Enzymes

Figure 26:
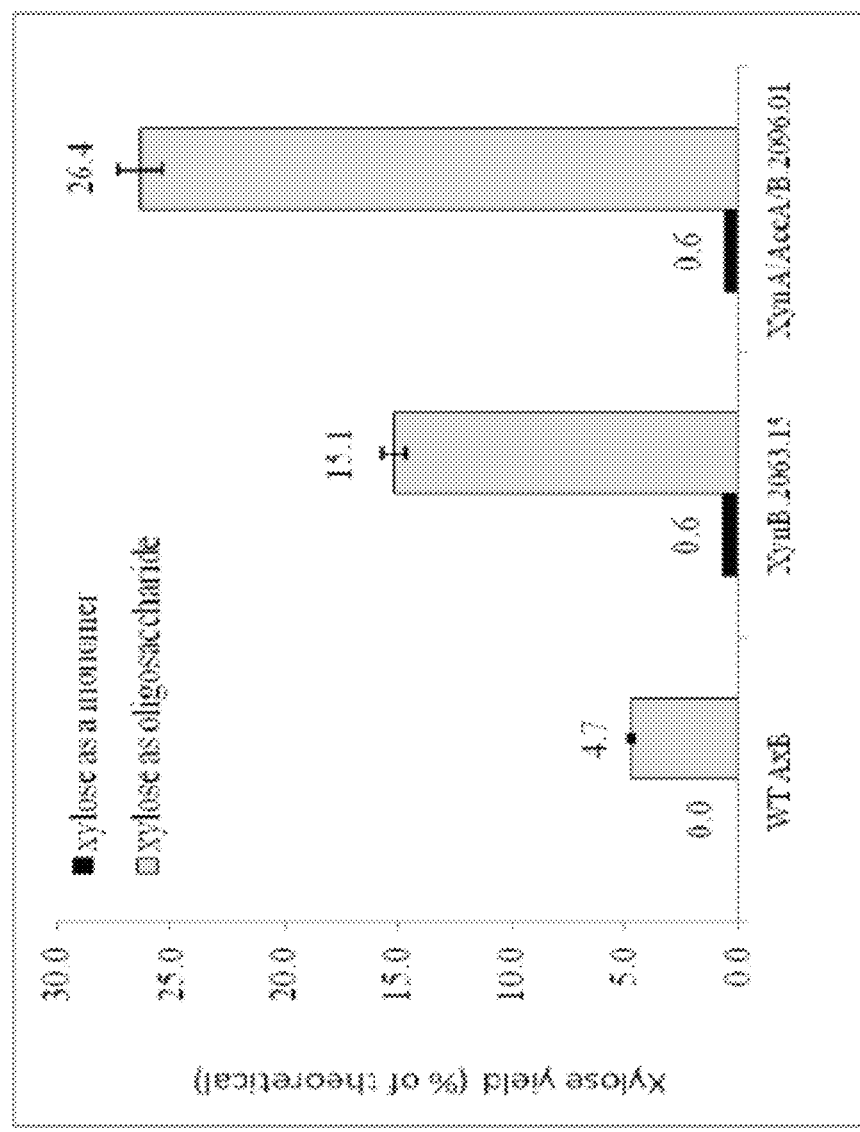
FIG. 26 illustrates xylose yield from a transgenic plant expressing xylanase B alone (XynB.2063.15), a transgenic plant expressing xylanase A and two accessory enzymes A and B (XynA/AccA/B.2096.1) and a non-transgenic control plant (WT A×B) following pretreatment with 0.17M ammonium bisulfite and ammonium carbonate (BSC; pH 8.1) and autohydrolysis. Xylose yield was assessed for xylose as a monomer (black (right)) and xylose as oligosaccharide (gray (left)).

Examples of autohydrolysis of plants expressing cell wall degrading enzymes are shown in FIG. 26. This figure illustrates results on a pretreated maize plant that expresses XynB (XynB.2063.15) alone and a plant that simultaneously express three enzymes; XynA and accessory enzymes A and B (XynA/AccA/B.2096.01). The results are compared to a pretreated non-transgenic control plant (A×B). Pretreatment was performed using 0.17 M ammonium bisulfite and 0.165 M ammonium carbonate (pH 8.1), liquid to solid ration (L/S) equal to 10, and at 55° C. for 16 hours. Enzymatic hydrolysis was achieved by enzymes produced in planta at 2% solids content with no external enzyme cocktail (NCt) and at a temperature of 50° C., pH 5.0 for 3 days. Post-acid hydrolysis was performed at pH less than 1.0 and a temperature of 121° C. for 60 minutes. Both transgenic plants expressing xylanase show 3-5 fold more xylose yield from autohydrolysis compared to the control A×B plant.

Figure 27:
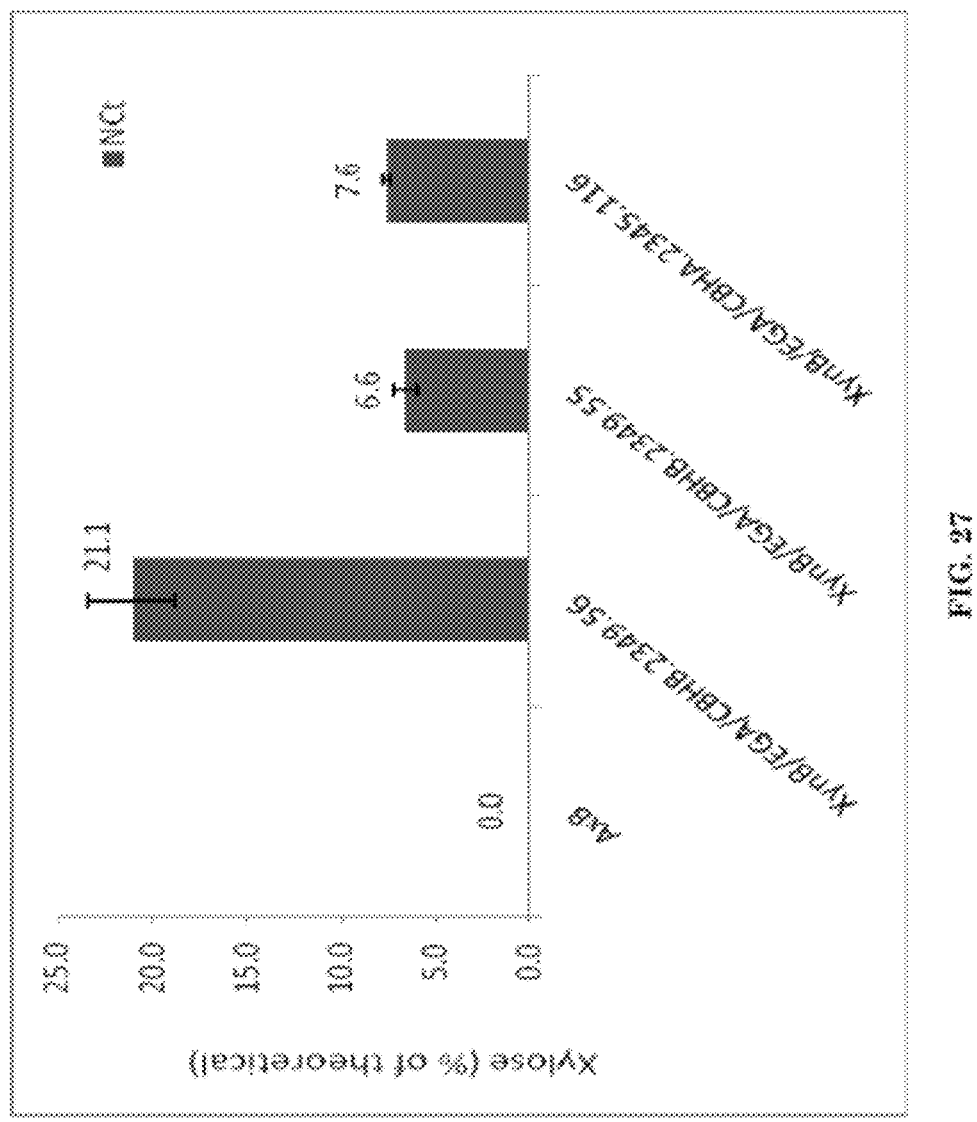
FIG. 27 illustrates xylose yields from two transgenic plant expressing xylanase B, endoglucanase, and CBHB (XynB/EGA/CBHB.2349.56 and XynB/EGA/CBHB.2349.55), a transgenic plant expressing xylanase B, endoglucanase and CBHA (XynB/EGA/CBHA.2345.116) and a non-transgenic control plant (A×B) following pretreatment with 0.17M ammonium bisulfite and 0.165M ammonium carbonate (BSC; pH 8.1) and autohydrolysis

FIG. 27 illustrates results of autohydrolysis for a corn plant simultaneously expressing xylanase B, endoglucanase and CHBA (XynB/EGA/CBHA.2345.116) and a plant expressing xylanase B, endoglucanase and CBHB (XynB/EGA/CBHB.2349.55) compared to a non-transgenic control plant (A×B). The plants were pretreated with 0.17 M ammonium bisulfite and 0.165M ammonium carbonate BSC (pH 8.1) with L/S equal to 10 at 55° C. for 16 hours. No intermediate washing procedures were applied between pretreatment and hydrolysis with enzymes expressed in planta. Hydrolysis was achieved under the following conditions: 2% solids content, no cocktail (NCt), 50° C. and pH 5.0 for 3 days. The transgenic plants expressing xylanase and other cellulases show significantly higher xylose yield from autohydrolysis compared to the control A×B plant.

Example 12

Effect of Mechanical Defibrillation on Processing of Unmilled Stover

Figure 28A:
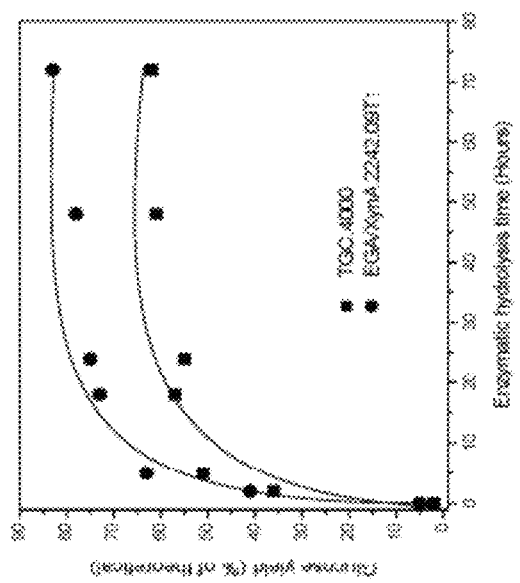
FIGS. 28A-28B illustrate glucose and xylose yields, respectively, from pretreated transgenic plants using Accellerase® XY. EGA/XynA.2242.09T1 (closed circle) simultaneously expressed endoglucanase and xylanase A, and the transgenic control plant was TGC.4000 (closed square).
Figure 28B:
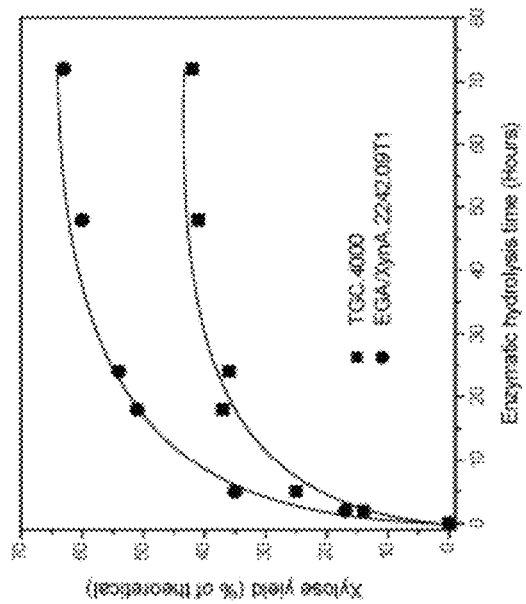
Figure 28D:
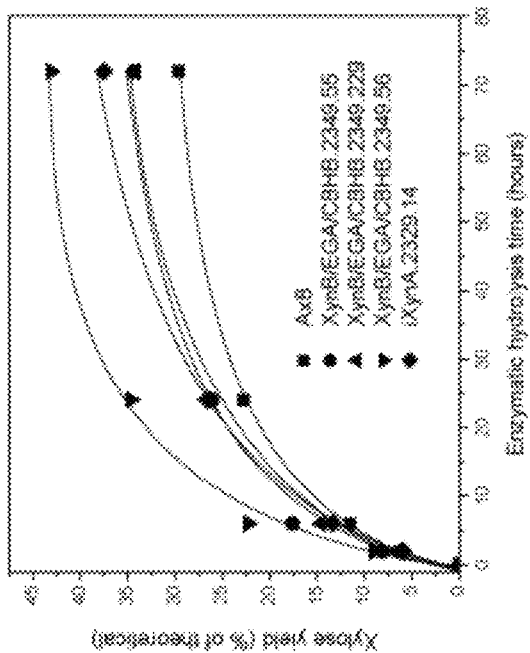
FIGS. 28C-28D show, respectively, glucose and xylose yields from XynB/EGA/CBHB.2349.55 (open circle), XynB/EGA/CBHB.2349.229 (closed triangle, point up), and XynB/EGA/CBHB.2349.56 (closed triangle, point down), each of which simultaneously expressed endoglucanase A, xylanase B, and cellobihydrolase B, and iXynA.2329.14, which expressed intein-modified xylanase A and a wild type control plant A×B.
Figure 28C:
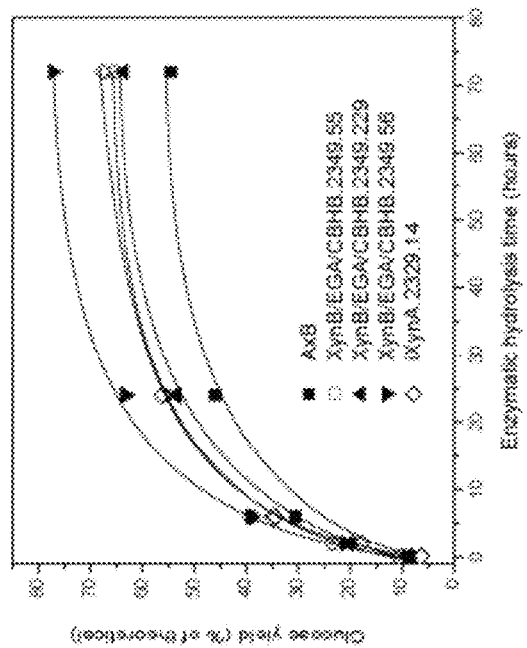

Data on the effect of mechanical defibrillation on glucose and xylose yields from processing of un-milled stover are shown in FIGS. 28A-28B. The data were derived from experiments with a pretreated transgenic plant expressing endoglucanase and xylanase A (EGA/XynA.2242.09T1) versus a transgenic control plant TGC.4000. Pretreatment was performed using 0.25M ammonium bisulfite with 0.23 M ammonium carbonate (pH 8.56, L/S equal to 8, 75° C., for 16 hours followed by mechanical defibrillation (6% solid content). Enzymatic hydrolysis was achieved by enzymes produced in planta at 4% solids content using Accelerase® 1500/XY (0.2/0.1 ml per g of stover) at a temperature of 50° C. for up to 3 days and at pH 5.0. The transgenic maize plant simultaneously expressing endoglucanase and xylanase shows consistently higher glucose and xylose yields compared the control TGC.4000 plant through the time-course, reaching 83% and 63% glucose and xylose yields, respectively, for 3-day hydrolysis.

The references cited throughout this application, are incorporated for all purposes apparent herein and in the references themselves as if each reference was fully set forth. For the sake of presentation, specific ones of these references are cited at particular locations herein. A citation of a reference at a particular location indicates a manner(s) in which the teachings of the reference are incorporated. However, a citation of a reference at a particular location does not limit the manner in which all of the teachings of the cited reference are incorporated for all purposes.

It is understood, therefore, that this invention is not limited to the particular embodiments disclosed, but is intended to cover all modifications which are within the spirit and scope of the invention as defined by the appended claims; the above description; and/or shown in the attached drawings.

SEQUENCE LISTING (85 sequences)

SEQ ID NO: 1 - protein, 337 aa, Dictyoglomus thermophilum
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 2 - protein, 261 aa, Aspergillus niger
MASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPADEGYAHGGVEYWSVDPYSAQNTFVCTGDEVQCCEAQGGQGVNDAHTTYFGMTSGACTW

SEQ ID NO: 3 - protein, 505 aa, Aspergillus niger
MATDPFQSRCNEFQNKIDIANVTVRSVAYVAAGQNISQAEVASVCKASVQASVDLCRVTMNISTSDRSHLWAEAWLPRNYTGRFVSTGNGGLAGCVQETDLNFAANFGFATVGTNGGHDGDTAKYFLNNSEVLADFAYRSVHEGTVVGKQLTQLFYDEGYNYSYYLGCSTGGRQGYQQVQRFPDDYDGVIAGSAAMNFINLISWGAFLWKATGLADDPDFISANLWSVIHQEIVRQCDLVDGALDGIIEDPDFCAPVIERLICDGTTNGTSCITGAQAAKVNRALSDFYGPDGTVYYPRLNYGGEADSASLYFTGSMYSRTEEWYKYVVYNDTNWNSSQWTLESAKLALEQNPFNIQAFDPNITAFRDRGGKLLSYHGTQDPIISSTDSKLYYRRVANALNAAPSELDEFYRFFQISGMGHCGDGTGASYIGQGYGTYTSKAPQVNLLRTMVDWVENGKAPEYMPGNKLNANGSIEYMRKHCRYPKHNIHTGPGNYTDPNSWTCV

SEQ ID NO: 4 - protein, 433 aa, Nasutitermes takasagoensis
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 5 - protein, 194 aa, Unknown
  EU591743 from unknown bacterium
MAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVS

SEQ ID NO: 6 - protein, 207 aa, Thermomyces lanuginosus
MFPAGNATELEKRQTTPNSEGWHDGYYYSWWSDGGAQATYTNLEGGTYEISWGDGGNLVGGKGWNPGLNARAIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVG

SEQ ID NO: 7 - protein, 761 aa, Artificial Sequence
  Synthetic construct, P77853:T134-100-101
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKNPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVGEAERRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 8 - protein, 760 aa, Artificial Sequence
  Synthetic construct, P77853:S158-30-108-35
MQTSITLTSNASGTFDGYNYELWKDTGNTTMTVYTQGRFSCQWSNINNALFRTGKKYNQNWQSLGTIRITYSATYNPNGNSYMCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPEHPLLTPEGWKPLCDLPLGTPIAVPAELPVAGHLAPPEERVMLLALLLGDGNTKLSGRRGTRPNAFFYSKDSELLAAYRRCAEALGAKVKAYVHPTTGVVTLATLAPRPGAQDPVKRLVVEAGMVAKVEEKRVPEEVFRYRREALALFLGRLFSTDGSVEKKRISYSSASLGLAQDVAHLLLRLGITSQLRSRGPRAHKVLISGREDILRFAELIGPYLLGAKRERLAALEAEARRRLPGQGWHLRPVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNSNNLARVDLRIDGRTVGTFYYQGTYPWEAPIDNVYVSAGSHTVEITVTADNGTRDVYADYLVIQ

SEQ ID NO: 9 - protein, 244 aa, Rhodothermus marinus
MCDWLFPDGDNGKEPEPEPEPTVELCGRWDARDVAGGRYRVINNVWGAETAQCIEVGLETGNFTITRADHDNGNNVAAYPAIYFGCHWAPARAIRDCAARAGAVRRAHELDVTPITTGRWNAAYDIWFSPVTNSGNGYSGGAELMIWLNWNGGVMPGGSRVATVELAGATWEVWYADWDWNYIAYRRTTPTTSVSELDLKAFIDDAVARGYIRPEWYLHAVETGFELWEGGAGLRTADFSVTVQ

SEQ ID NO: 10 - protein, 869 aa, Clostridium thermocellum
MLEDKSPKLPDYKNDLLYERTFDEGLCFPWHTCEDSGGKCDFAVVDVPGEPGNKAFRLTVIDKGQNKWSVQMRHRGITLEQGHTYTVRFTIWSDKSCRVYAKIGQMGEPYTEYWNNNWNPFNLTPGQKLTVEQNFTMNYPTDDTCEFTFHLGGELAAGTPYYVYLDDVSLYDPRFVKPVEYVLPQPDVRVNQVGYLPFAKKYATVVSSSTSPLKWQLLNSANQVVLEGNTIPKGLDKDSQDYVHWIDFSNFKTEGKGYYFKLPTVNSDTNYSHPFDISADIYSKMKFDALAFFYHKRSGIPIEMPYAGGEQWTRPAGHIGVAPNKGDTNVPTWPQDDEYAGRPQKYYTKDVTGGWYDAGDHGKYVVNGGIAVWTLMNMYERAKIRGIANQGAYKDGGMNIPERNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPSADIQKARNNIAKAADKWLENIEEQGYRLPIKQAEDERGGYPWGSNSFILNQMIVMGYAYDFTGNSKYLDGMQDGMSYLLGRNGLDQSYVTGYGERPLQNPHDRFWTPQTSKKFPAPPPGIIAGGPNSRFEDPTITAAVKKDTPPQKCYIDHTDSWSTNEITINWNAPFAWVTAYLDEIDLITPPGGVDPEEPEVIYGDCNGDGKVNSTDAVALKRYILRSGISINTDNADVNADGRVNSTDLAILKRYILKEIDVLPHK

SEQ ID NO: 11 - protein, 522 aa, Acidothermus cellulolyticus
MAGGGYWHTSGREILDANNVPVRIAGINWFGFETCNYVVHGLWSRDYRSMLDQIKSLGYNTIRLPYSDDILKPGTMPNSINFYQMNQDLQGLTSLQVMDKIVAYAGQIGLRIILDRHRPDCSGQSALWYTSSVSEATWISDLQALAQRYKGNPTVVGFDLHNEPHDPACWGCGDPSIDWRLAAERAGNAVLSVNPNLLIFVEGVQSYNGDSYWWGGNLQGAGQYPVVLNVPNRLVYSAHDYATSVYPQTWFSDPTFPNNMPGIWNKNWGYLFNQNIAPVWLGEFGTTLQSTTDQTWLKTLVQYLRPTAQYGADSFQWTFWSWNPDSGDTGGILKDDWQTVDTVKDGYLAPIKSSIFDPVGASASPSSQPSPSVSPSPSPSPSASRTPTPTPTPTASPTPTLTPTATPTPTASPTPSPTAASGARCTASYQVNSDWGNGFTVTVAVTNSGSVATKTWTVSWTFGGNQTITNSWNAAVTQNGQSVTARNMSYNNVIQPGQNTTFGFQASYTGSNAAPTVACAAS

SEQ ID NO: 12 - protein, 513 aa, Penicillium funiculosum
MQQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSSNNANTGLGNHGACCAELDIWEANSISEALTPHPCDTPGLSVCTTDACGGTYSSDRYAGTCDPDGCDFNPYRLGVTDFYGSGKTVDTTKPITVVTQFVTDDGTSTGTLSEIRRYYVQNGVVIPQPSSKISGVSGNVINSDFCDAEISTFGETASFSKHGGLAKMGAGMEAGMVLVMSLWDDYSVNMLWLDSTYPTNATGTPGAARGSCPTTSGDPKTVESQSGSSYVTFSDIRVGPFNSTFSGGSSTGGSSTTTASGTTTTKASSTSTSSTSTGTGVAAHWGQCGGQGWTGPTTCASGTTCTVVNPYYSQCLDELKAEAK

SEQ ID NO: 13 - protein, 26 aa, Artificial Sequence
  Synthetic construct, targeting peptide BAASS
MANKHLSLSLFLVLLGLSASLASGQV

SEQ ID NO: 14 - protein, 43 aa, Hordeum vulgare
MAHARVLLLALAVLATAAVAVASSSSFADSNPIRPVTDRAAST

SEQ ID NO: 15 - protein, 30 aa, Artificial Sequence
  Synthetic construct, targeting peptide PR1a
MGFVLFSQLPSFLLVSTLLLFLVISHSCRA

SEQ ID NO: 16 - protein, 19 aa, Zea mays
MRVLLVALALLALAASATS

SEQ ID NO: 17 - protein, 24 aa, Oryza sativa
MATIAFSRLSIYFCVLLLCHGSMA

SEQ ID NO: 18 - protein, 361 aa, Artificial Sequence
  Synthetic construct, BAASS:P77853
MANKHLSLSLFLVLLGLSASLASGQQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 19 - protein, 270 aa, Artificial Sequence
  Synthetic construct, BAASS:O33897
MANKHLSLSLFLVLLGLSASLASGQQVCDWLFPDGDNGKEPEPEPEPTVELCGRWDARDVAGGRYRVINNVWGAETAQCIEVGLETGNFTITRADHDNGNNVAAYPAIYFGCHWAPARAIRDCAARAGAVRRAHELDVTPITTGRWNAAYDIWFSPVTNSGNGYSGGAELMIWLNWNGGVMPGGSRVATVELAGATWEVWYADWDWNYIAYRRTTPTTSVSELDLKAFIDDAVARGYIRPEWYLHAVETGFELWEGGAGLRTADFSVTVQ

SEQ ID NO: 20 - protein, 475 aa, Artificial Sequence
  Synthetic construct, HvAleSP:NtEGM
MAHARVLLLALAVLATAAVAVASSSSFADSNPIRPVTDRAASTAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 21 - protein, 784 aa, Artificial Sequence
  Synthetic construct, BAASS:P77853:S158-30-108-35
MANKHLSLSLFLVLLGLSASLASGQQTSITLTSNASGTFDGYNYELWKDTGNTTMTVYTQGRFSCQWSNINNALFRTGKKYNQNWQSLGTIRITYSATYNPNGNSYMCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPEHPLLTPEGWKPLCDLPLGTPIAVPAELPVAGHLAPPEERVMLLALLLGDGNTKLSGRRGTRPNAFFYSKDSELLAAYRRCAEALGAKVKAYVHPTTGVVTLATLAPRPGAQDPVKRLVVEAGMVAKVEEKRVPEEVFRYRREALALFLGRLFSTDGSVEKKRISYSSASLGLAQDVAHLLLRLGITSQLRSRGPRAHKVLISGREDILRFAELIGPYLLGAKRERLAALEAEARRRLPGQGWHLRPVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNSNNLARVDLRIDGRTVGTFYYQGTYPWEAPIDNVYVSAGSHTVEITVTADNGTRDVYADYLVIQ

SEQ ID NO: 22 - protein, 6 aa, Artificial Sequence
  Synthetic construct, SEKDEL
SEKDEL

SEQ ID NO: 23 - protein, 4 aa, Artificial Sequence
  Synthetic construct, KDEL
KDEL

SEQ ID NO: 24 - protein, 8 aa, Hordeum vulgare
DELKAEAK

SEQ ID NO: 25 - protein, 536 aa, Artificial Sequence
  Synthetic construct, BAASS:AnfaeB:SEKDEL
MANKHLSLSLFLVLLGLSASLASGQVATDPFQSRCNEFQNKIDIANVTVRSVAYVAAGQNISQAEVASVCKASVQASVDLCRVTMNISTSDRSHLWAEAWLPRNYTGRFVSTGNGGLAGCVQETDLNFAANFGFATVGTNGGHDGDTAKYFLNNSEVLADFAYRSVHEGTVVGKQLTQLFYDEGYNYSYYLGCSTGGRQGYQQVQRFPDDYDGVIAGSAAMNFINLISWGAFLWKATGLADDPDFISANLWSVIHQEIVRQCDLVDGALDGIIEDPDFCAPVIERLICDGTTNGTSCITGAQAAKVNRALSDFYGPDGTVYYPRLNYGGEADSASLYFTGSMYSRTEEWYKYVVYNDTNWNSSQWTLESAKLALEQNPFNIQAFDPNITAFRDRGGKLLSYHGTQDPIISSTDSKLYYRRVANALNAAPSELDEFYRFFQISGMGHCGDGTGASYIGQGYGTYTSKAPQVNLLRTMVDWVENGKAPEYMPGNKLNANGSIEYMRKHCRYPKHNIHTGPGNYTDPNSWTCVSEKDEL

SEQ ID NO: 26 - protein, 292 aa, Artificial Sequence
  Synthetic construct, BAASS:AnfaeA:SEKDEL
MANKHLSLSLFLVLLGLSASLASGQVASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPADEGYAHGGVEYWSVDPYSAQNTFVCTGDEVQCCEAQGGQGVNDAHTTYFGMTSGACTWSEKDEL

SEQ ID NO: 27 - protein, 468 aa, Artificial Sequence
  Synthetic construct, PR1a:NtEGM:SEKDEL
MGFVLFSQLPSFLLVSTLLLFLVISHSCRAAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGYSEKDEL

SEQ ID NO: 28 - protein, 791 aa, Artificial Sequence
  Synthetic construct, BAASS:P77853:T134-100-101:SEKDEL
MANKHLSLSLFLVLLGLSASLASGQQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKNPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVGEAERRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQSEKDEL

SEQ ID NO: 29 - protein, 481 aa, Artificial Sequence
  Synthetic construct, HvAleSP:NtEGM:SEKDEL
MAHARVLLLALAVLATAAVAVASSSSFADSNPIRPVTDRAASTAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGYSEKDEL

SEQ ID NO: 30 - protein, 238 aa, Artificial Sequence
  Synthetic construct, BAASS:O43097:SEKDEL
MANKHLSLSLFLVLLGLSASLASGQVFPAGNATELEKRQTTPNSEGWHDGYYYSWWSDGGAQATYTNLEGGTYEISWGDGGNLVGGKGWNPGLNARAIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVGSEKDEL

SEQ ID NO: 31 - protein, 531 aa, Artificial Sequence
  Synthetic construct, xGZein27ss-02:BD22308:HvVSD-01
MRVLLVALALLALAASATSQQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSSNNANTGLGNHGACCAELDIWEANSISEALTPHPCDTPGLSVCTTDACGGTYSSDRYAGTCDPDGCDFNPYRLGVTDFYGSGKTVDTTKPITVVTQFVTDDGTSTGTLSEIRRYYVQNGVVIPQPSSKISGVSGNVINSDFCDAEISTFGETASFSKHGGLAKMGAGMEAGMVLVMSLWDDYSVNMLWLDSTYPTNATGTPGAARGSCPTTSGDPKTVESQSGSSYVTFSDIRVGPFNSTFSGGSSTGGSSTTTASGTTTTKASSTSTSSTSTGTGVAAHWGQCGGQGWTGPTTCASGTTCTVVNPYYSQCLDELKAEAK

SEQ ID NO: 32 - DNA, 1014 bp, Artificial Sequence
  Synthetic construct, plant optimized P77853
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 33 - DNA, 786 bp, Artificial Sequence
  Synthetic construct, plant optimized Anfae A
atggcatccacgcagggtatctctgaggacctgtataatcgcctcgtggaaatggccacaatttcacaagcggcttacgcagatctttgtaatatcccttcgacaattatcaagggagagaaaatctataacgcccagactgacatcaacggctggatactgcgggatgacacgagcaaggaaattatcacagtctttagagggaccggttccgatacaaatttgcagttggacacgaattacacactgacccccttcgatactctccctcaatgcaacgactgtgaggttcacggtgggtactatattggctggatctctgttcaagaccaagtcgagtcacttgttaagcagcaagcgtcgcagtacccggactacgcattgacggtgacagggcacagcctgggtgcctcgatggcagcgctcaccgctgcccagctttctgcaacctacgataatgtcaggctgtacactttcggagaaccacgctcaggcaaccaagcgtttgcttcgtatatgaacgacgctttccaggttagctcccccgagacgacacaatactttcgggtgacccattctaacgacgggattcctaacctcccgccagccgacgaaggttacgcacacgggggtgtcgagtactggtcagtggacccctacagcgcgcagaatactttcgtttgcacgggcgatgaggtccagtgctgtgaagctcaagggggtcagggagtgaatgatgcacacacaacctatttcggaatgacttccggggcttgcacgtggtga

SEQ ID NO: 34 - DNA, 1518 bp, Artificial Sequence
  Synthetic construct, plant optimized Anfae B
atggctactgatcccttccagtctcgctgtaacgagtttcaaaacaaaattgatatcgcaaacgtcacggttaggtcggtcgcctacgtcgcggctggtcagaatatctctcaagcagaagtcgcttcggtttgcaaggcaagcgtccaggcctccgtggacctctgtagagtgacaatgaatattagcacctcggataggagccacctttgggccgaggcttggctgcctcgcaattatactggacggttcgtctccactgggaacgggggcctggctggatgcgtgcaggaaacagacttgaatttcgctgccaactttggcttcgcaaccgttggcactaatggagggcacgatggagacacggcgaaatactttctgaataactctgaggtcctcgctgatttcgcctatcgcagcgttcacgagggcactgtggtcgggaagcaacttacccagttgttctacgacgaaggttacaattattcgtactatctgggctgcagcaccggaggcaggcaaggctatcagcaagtgcagcgctttccggatgactacgatggtgttattgccggaagtgcagcgatgaactttatcaatttgatttcttggggcgcttttctttggaaggccacgggactcgcagacgacccagattttatctcagcgaacctctggagcgttatccaccaggagattgtgcggcagtgtgacttggttgatggtgctcttgacggaattattgaagatcctgacttctgcgcccctgttatcgagagactgatttgtgatgggactaccaacggcacctcctgtatcactggggcacaagcggctaaagtgaatagggccctctcggacttttatggtccggatgggacagtctactatccacgcttgaactacggaggggaggcagactctgcgagcctgtacttcacaggctccatgtattcacggaccgaagagtggtacaagtacgtcgtgtacaacgatactaactggaatagttctcaatggacgctcgaaagcgctaagttggccttggagcagaacccctttaatattcaggcattcgaccctaatatcacagcgttcagggaccgcggtggaaaactcttgagctaccacggcacccaagatccgattatttcatcgactgacagcaagttgtattacagaagagttgctaacgcccttaacgctgccccatccgaactcgacgagttttatcgcttctttcagatctctgggatgggtcactgcggcgacggaaccggggcttcatacattggccagggatacggcacgtatacctcgaaggccccacaggtcaacttgcttcggactatggtggattgggttgagaatggaaaagctccggaatatatgcctgggaataagttgaacgccaacggttcgatcgagtatatgagaaagcactgtcgttacccaaaacacaatattcacacgggcccaggtaactacacggaccctaactcctggacctgcgtctga

SEQ ID NO: 35 - DNA, 1302 bp, Artificial Sequence
  Synthetic construct, plant optimized NtEGM
atggcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 36 - DNA, 585 bp, Artificial Sequence
  Synthetic construct, plant optimized EU591743
atggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatga

SEQ ID NO: 37 - DNA, 624 bp, Artificial Sequence
  Synthetic construct, plant optimized O43097
atgttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggatga

SEQ ID NO: 38 - DNA, 2286 bp, Artificial Sequence
  Synthetic construct, plant optimized P77853:T134-100-101
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggcggaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 39 - DNA, 2283 bp, Artificial Sequence
  Synthetic construct, plant optimized  P77853:S158-30-108-35
atgcaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtga

SEQ ID NO: 40 - DNA, 735 bp, Artificial Sequence
  Synthetic construct, plant optimized 033897
atgtgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtga

SEQ ID NO: 41 - DNA, 2610 bp, Artificial Sequence
  Synthetic construct, plant optimized O68438
atgctggaggacaagtctcccaaactgcctgattataagaacgaccttctgtacgaacgcacattcgacgaggggctctgcttcccgtggcacacgtgcgaagattcaggagggaaatgcgattttgccgtggtcgacgttccaggcgagcctgggaacaaggcgttcaggctcactgttatcgataagggtcagaacaagtggtcggtccaaatgagacaccggggtatcacgttggagcaggggcacacatacaccgttcggtttactatctggagcgacaagagctgccgcgtgtatgccaaaatcggccaaatgggtgaaccctacacggagtactggaacaataactggaatccgttcaacctcactccggggcagaaattgacggtggaacagaactttactatgaattatcccacggacgacacgtgtgagtttaccttccacttgggaggggaactggcagccgggaccccttactacgtgtacctcgacgacgtttctctttacgatccccgctttgtcaagccagtggaatacgtcctgcctcaaccggatgtcagggttaatcaagttggatacctcccttttgctaagaaatatgctactgtcgtgtcatcgagcacgtccccattgaagtggcaacttctgaatagtgcaaaccaagttgtcttggagggcaatacaatccccaagggactggacaaagattcacaagactacgttcattggatcgatttctcgaactttaagaccgaaggcaaggggtactatttcaagttgcccactgtgaactccgatactaactactcccacccgtttgatatttctgcagatatctattcaaagatgaagttcgacgcgctcgctttcttttaccataaaaggtcgggaataccaatcgagatgccctacgccgggggagagcagtggacaaggcccgcagggcacattggtgtcgcgccgaacaagggcgacacgaatgtgccaacttggccccaggatgacgaatatgctggacgcccccagaaatactatacgaaagacgtgaccggcgggtggtacgatgccggtgaccacggcaagtacgtcgtgaacgggggtatcgcagtttggacccttatgaatatgtacgagagagcaaagattagaggaatcgctaaccagggtgcctacaaagatggaggaatgaatatcccggaaaggaataacggctatcctgatattctggacgaggccagatgggagatcgaattttttaagaagatgcaagtcactgagaaagaagatccgtcgattgcaggtatggtgcaccacaagatccacgatttcaggtggacggcgctcggaatgttgcctcacgaggacccccagccacgctaccttcggcccgtcagcacagcggcaaccctgaatttcgcagcgaccctcgctcagtctgccagattgtggaaggattacgacccgacttttgcagcggactgccttgagaaagctgaaattgcctggcaagcagcactcaaacacccggacatctacgctgagtacacgccaggaagcggtgggccgggtggaggtccttataatgacgattatgtcggggacgagttctactgggccgcttgtgaactctatgtgacaaccggtaaggatgagtacaagaattacttgatgaatagtccgcactatctggaaatgccagcgaagatgggcgagaacggaggggctaacggcgaggacaacggtctctggggctgctttacttggggaacgacacaggggttgggtacaattacccttgccctcgttgaaaacggcctcccttcggcggatattcaaaaggcccgcaacaatatcgctaaagccgcagataagtggcttgagaatattgaagaacaaggttaccgcctgcctatcaaacaagcggaggatgaacggggcggatacccgtggggtagtaattctttcattctcaaccagatgatcgtcatgggctacgcttacgacttcacgggaaacagcaagtatcttgacgggatgcaggacggcatgtcctacctgctcggtagaaacggacttgatcaatcgtacgttactgggtacggggagaggccacttcagaacccccacgaccgcttttggacccctcaaacttcgaagaaattcccggccccaccccctggtattatcgcaggcgggccgaatagccggtttgaagatccaacgatcactgcagcggttaagaaggatacacccccgcagaagtgctatattgaccacaccgattcctggtctactaacgagatcacgattaattggaacgcccccttcgcgtgggtcacagcgtatctggacgaaattgacttgattaccccacccggcggagtggaccctgaagagccggaagttatctacggtgattgtaacggcgacggaaaggttaattcgaccgatgctgtggcccttaaaaggtatatcctccgcagcggtatctcgatcaacacggacaacgcggacgttaatgcagatggtcgcgtgaatagcactgacctcgctattttgaagcgctatattttgaaggagatcgatgttcttcctcacaagtga

SEQ ID NO: 42 - DNA, 1569 bp, Artificial Sequence
  Synthetic construct, plant optimized P54583
atggctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctcatga

SEQ ID NO: 43 - DNA, 1542 bp, Artificial Sequence
  Synthetic construct, plant optimized BD22308
atgcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtga

SEQ ID NO: 44 - DNA, 78 bp, Artificial Sequence
  Synthetic construct, BAASS
atggcgaacaaacatttgtccctctccctcttcctcgtcctccttggcctgtcggccagcttggcctccgggcaagtc

SEQ ID NO: 45 - DNA, 129 bp, Artificial Sequence
  Synthetic construct, HvAleSP
atggcccacgcccgcgtcctcctcctggcgctcgccgtcctggccaccgccgccgtcgccgtcgcctcctcctcctccttcgccgactccaacccgatccgcccggtgaccgaccgcgccgcctccacc

SEQ ID NO: 46 - DNA, 90 bp, Artificial Sequence
  Synthetic construct, PR1a
atgggcttcgtgctcttctcccagctgccttccttccttcttgtctccaccctgctcttgttcctcgtgatctcccactcctgccgcgcc

SEQ ID NO: 47 - DNA, 57 bp, Artificial Sequence
  Synthetic construct, xGZein27ss-02
atgcgcgtgctgctcgtggccctggccctgctggctcttgctgccagcgccacctct

SEQ ID NO: 48 - DNA, 72 bp, Artificial Sequence
  Synthetic construct, GluB4SP
atggccaccatcgctttctcccgcttgtccatctacttctgcgtgcttctcctgtgccacggctccatggcc

SEQ ID NO: 49 - DNA, 18 bp, Artificial Sequence
  Synthetic construct, SEKDEL
agcgagaaggacgagctg

SEQ ID NO: 50 - DNA, 12 bp, Artificial Sequence
  Synthetic construct, KDEL
aaggacgagctg

SEQ ID NO: 51 - DNA, 24 bp, Artificial Sequence
  Synthetic construct, HvVSD
gacgagctgaaggccgaggccaag

SEQ ID NO: 52 - DNA, 1086 bp, Artificial Sequence
  Synthetic construct, BAASS:P77853
atggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 53 - DNA, 813 bp, Artificial Sequence
  Synthetic construct, BAASS:O33897
atggcgaacaaacatttgtccctctccctcttcctcgtcctccttggcctgtcggccagcttggcctccgggcaacaggtgtgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtga

SEQ ID NO: 54 - DNA, 1428 bp, Artificial Sequence
  Synthetic construct, HvAleSP:NtEGM
atggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 55 - DNA, 2355 bp, Artificial Sequence
  Synthetic construct, BAASS:P77853:S158-30-108-35
atggcgaacaaacatttgtccctctccctcttcctcgtcctccttggcctgtcggccagcttggcctccgggcaacaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtga

SEQ ID NO: 56 - DNA, 1611 bp, Artificial Sequence
  Synthetic construct, BAASS:AnfaeB:SEKDEL
atggcgaacaaacatttgtccctctccctcttcctcgtcctccttggcctgtcggccagcttggcctccgggcaagtcgctactgatcccttccagtctcgctgtaacgagtttcaaaacaaaattgatatcgcaaacgtcacggttaggtcggtcgcctacgtcgcggctggtcagaatatctctcaagcagaagtcgcttcggtttgcaaggcaagcgtccaggcctccgtggacctctgtagagtgacaatgaatattagcacctcggataggagccacctttgggccgaggcttggctgcctcgcaattatactggacggttcgtctccactgggaacgggggcctggctggatgcgtgcaggaaacagacttgaatttcgctgccaactttggcttcgcaaccgttggcactaatggagggcacgatggagacacggcgaaatactttctgaataactctgaggtcctcgctgatttcgcctatcgcagcgttcacgagggcactgtggtcgggaagcaacttacccagttgttctacgacgaaggttacaattattcgtactatctgggctgcagcaccggaggcaggcaaggctatcagcaagtgcagcgctttccggatgactacgatggtgttattgccggaagtgcagcgatgaactttatcaatttgatttcttggggcgcttttctttggaaggccacgggactcgcagacgacccagattttatctcagcgaacctctggagcgttatccaccaggagattgtgcggcagtgtgacttggttgatggtgctcttgacggaattattgaagatcctgacttctgcgcccctgttatcgagagactgatttgtgatgggactaccaacggcacctcctgtatcactggggcacaagcggctaaagtgaatagggccctctcggacttttatggtccggatgggacagtctactatccacgcttgaactacggaggggaggcagactctgcgagcctgtacttcacaggctccatgtattcacggaccgaagagtggtacaagtacgtcgtgtacaacgatactaactggaatagttctcaatggacgctcgaaagcgctaagttggccttggagcagaacccctttaatattcaggcattcgaccctaatatcacagcgttcagggaccgcggtggaaaactcttgagctaccacggcacccaagatccgattatttcatcgactgacagcaagttgtattacagaagagttgctaacgcccttaacgctgccccatccgaactcgacgagttttatcgcttctttcagatctctgggatgggtcactgcggcgacggaaccggggcttcatacattggccagggatacggcacgtatacctcgaaggccccacaggtcaacttgcttcggactatggtggattgggttgagaatggaaaagctccggaatatatgcctgggaataagttgaacgccaacggttcgatcgagtatatgagaaagcactgtcgttacccaaaacacaatattcacacgggcccaggtaactacacggaccctaactcctggacctgcgtcagcgagaaggacgagctgtga

SEQ ID NO: 57 - DNA, 879 bp, Artificial Sequence
  Synthetic construct, BAASS:AnfaeA:SEKDEL
atggcgaacaaacatttgtccctctccctcttcctcgtcctccttggcctgtcggccagcttggcctccgggcaagtcgcatccacgcagggtatctctgaggacctgtataatcgcctcgtggaaatggccacaatttcacaagcggcttacgcagatctttgtaatatcccttcgacaattatcaagggagagaaaatctataacgcccagactgacatcaacggctggatactgcgggatgacacgagcaaggaaattatcacagtctttagagggaccggttccgatacaaatttgcagttggacacgaattacacactgacccccttcgatactctccctcaatgcaacgactgtgaggttcacggtgggtactatattggctggatctctgttcaagaccaagtcgagtcacttgttaagcagcaagcgtcgcagtacccggactacgcattgacggtgacagggcacagcctgggtgcctcgatggcagcgctcaccgctgcccagctttctgcaacctacgataatgtcaggctgtacactttcggagaaccacgctcaggcaaccaagcgtttgcttcgtatatgaacgacgctttccaggttagctcccccgagacgacacaatactttcgggtgacccattctaacgacgggattcctaacctcccgccagccgacgaaggttacgcacacgggggtgtcgagtactggtcagtggacccctacagcgcgcagaatactttcgtttgcacgggcgatgaggtccagtgctgtgaagctcaagggggtcagggagtgaatgatgcacacacaacctatttcggaatgacttccggggcttgcacgtggagcgagaaggacgagctgtga

SEQ ID NO: 58 - DNA, 1407 bp, Artificial Sequence
  Synthetic construct, PR1a:NtEGM:SEKDEL
atgggcttcgtgctcttctcccagctgccttccttccttcttgtctccaccctgctcttgttcctcgtgatctcccactcctgccgcgccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtga

SEQ ID NO: 59 - DNA, 2376 bp, Artificial Sequence
  Synthetic construct, BAASS:P77853:T134-100-101:SEKDEL
atggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggcggaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagagcgagaaggacgagctgtga

SEQ ID NO: 60 - DNA, 1446 bp, Artificial Sequence
  Synthetic construct, HvAleSP:NtEGM:SEKDEL
atggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtga

SEQ ID NO: 61 - DNA, 717 bp, Artificial Sequence
  Synthetic construct, BAASS:O43097:SEKDEL
atggcgaacaaacatttgtccctctccctcttcctcgtcctccttggcctgtcggccagcttggcctccgggcaagtcttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggaagcgagaaggacgagctgtga

SEQ ID NO: 62 - DNA, 1596 bp, Artificial Sequence
  Synthetic construct, xGZein27ss-02:BD22308:HvVSD-01
atgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtga

SEQ ID NO: 63 - DNA, 13321 bp, Artificial Sequence
  Synthetic construct, vector pAG2015
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 64 - DNA, 13735 bp, Artificial Sequence
  Synthetic construct, vector pAG2048
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 65 - DNA, 13753 bp, Artificial Sequence
  Synthetic construct vector pAG2049
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 66 - DNA, 13024 bp, Artificial Sequence
  Synthetic construct, vector pAG2063
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaagtcttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 67 - DNA, 14917 bp, Artificial Sequence
  Synthetic construct, vector pAG2069
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtctcccaaactgcctgattataagaacgaccttctgtacgaacgcacattcgacgaggggctctgcttcccgtggcacacgtgcgaagattcaggagggaaatgcgattttgccgtggtcgacgttccaggcgagcctgggaacaaggcgttcaggctcactgttatcgataagggtcagaacaagtggtcggtccaaatgagacaccggggtatcacgttggagcaggggcacacatacaccgttcggtttactatctggagcgacaagagctgccgcgtgtatgccaaaatcggccaaatgggtgaaccctacacggagtactggaacaataactggaatccgttcaacctcactccggggcagaaattgacggtggaacagaactttactatgaattatcccacggacgacacgtgtgagtttaccttccacttgggaggggaactggcagccgggaccccttactacgtgtacctcgacgacgtttctctttacgatccccgctttgtcaagccagtggaatacgtcctgcctcaaccggatgtcagggttaatcaagttggatacctcccttttgctaagaaatatgctactgtcgtgtcatcgagcacgtccccattgaagtggcaacttctgaatagtgcaaaccaagttgtcttggagggcaatacaatccccaagggactggacaaagattcacaagactacgttcattggatcgatttctcgaactttaagaccgaaggcaaggggtactatttcaagttgcccactgtgaactccgatactaactactcccacccgtttgatatttctgcagatatctattcaaagatgaagttcgacgcgctcgctttcttttaccataaaaggtcgggaataccaatcgagatgccctacgccgggggagagcagtggacaaggcccgcagggcacattggtgtcgcgccgaacaagggcgacacgaatgtgccaacttggccccaggatgacgaatatgctggacgcccccagaaatactatacgaaagacgtgaccggcgggtggtacgatgccggtgaccacggcaagtacgtcgtgaacgggggtatcgcagtttggacccttatgaatatgtacgagagagcaaagattagaggaatcgctaaccagggtgcctacaaagatggaggaatgaatatcccggaaaggaataacggctatcctgatattctggacgaggccagatgggagatcgaattttttaagaagatgcaagtcactgagaaagaagatccgtcgattgcaggtatggtgcaccacaagatccacgatttcaggtggacggcgctcggaatgttgcctcacgaggacccccagccacgctaccttcggcccgtcagcacagcggcaaccctgaatttcgcagcgaccctcgctcagtctgccagattgtggaaggattacgacccgacttttgcagcggactgccttgagaaagctgaaattgcctggcaagcagcactcaaacacccggacatctacgctgagtacacgccaggaagcggtgggccgggtggaggtccttataatgacgattatgtcggggacgagttctactgggccgcttgtgaactctatgtgacaaccggtaaggatgagtacaagaattacttgatgaatagtccgcactatctggaaatgccagcgaagatgggcgagaacggaggggctaacggcgaggacaacggtctctggggctgctttacttggggaacgacacaggggttgggtacaattacccttgccctcgttgaaaacggcctcccttcggcggatattcaaaaggcccgcaacaatatcgctaaagccgcagataagtggcttgagaatattgaagaacaaggttaccgcctgcctatcaaacaagcggaggatgaacggggcggatacccgtggggtagtaattctttcattctcaaccagatgatcgtcatgggctacgcttacgacttcacgggaaacagcaagtatcttgacgggatgcaggacggcatgtcctacctgctcggtagaaacggacttgatcaatcgtacgttactgggtacggggagaggccacttcagaacccccacgaccgcttttggacccctcaaacttcgaagaaattcccggccccaccccctggtattatcgcaggcgggccgaatagccggtttgaagatccaacgatcactgcagcggttaagaaggatacacccccgcagaagtgctatattgaccacaccgattcctggtctactaacgagatcacgattaattggaacgcccccttcgcgtgggtcacagcgtatctggacgaaattgacttgattaccccacccggcggagtggaccctgaagagccggaagttatctacggtgattgtaacggcgacggaaaggttaattcgaccgatgctgtggcccttaaaaggtatatcctccgcagcggtatctcgatcaacacggacaacgcggacgttaatgcagatggtcgcgtgaatagcactgacctcgctattttgaagcgctatattttgaaggagatcgatgttcttcctcacaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 68 - DNA, 16551 bp, Artificial Sequence
  Synthetic construct, vector pAG2091
catggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagcacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaagtcgcatccacgcagggtatctctgaggacctgtataatcgcctcgtggaaatggccacaatttcacaagcggcttacgcagatctttgtaatatcccttcgacaattatcaagggagagaaaatctataacgcccagactgacatcaacggctggatactgcgggatgacacgagcaaggaaattatcacagtctttagagggaccggttccgatacaaatttgcagttggacacgaattacacactgacccccttcgatactctccctcaatgcaacgactgtgaggttcacggtgggtactatattggctggatctctgttcaagaccaagtcgagtcacttgttaagcagcaagcgtcgcagtacccggactacgcattgacggtgacagggcacagcctgggtgcctcgatggcagcgctcaccgctgcccagctttctgcaacctacgataatgtcaggctgtacactttcggagaaccacgctcaggcaaccaagcgtttgcttcgtatatgaacgacgctttccaggttagctcccccgagacgacacaatactttcgggtgacccattctaacgacgggattcctaacctcccgccagccgacgaaggttacgcacacgggggtgtcgagtactggtcagtggacccctacagcgcgcagaatactttcgtttgcacgggcgatgaggtccagtgctgtgaagctcaagggggtcagggagtgaatgatgcacacacaacctatttcggaatgacttccggggcttgcacgtggagcgagaaggacgagctgtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgc

SEQ ID NO: 69 - DNA, 17296 bp, Artificial Sequence
  Synthetic construct, vector pAG2092
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggcacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaagtcgctactgatcccttccagtctcgctgtaacgagtttcaaaacaaaattgatatcgcaaacgtcacggttaggtcggtcgcctacgtcgcggctggtcagaatatctctcaagcagaagtcgcttcggtttgcaaggcaagcgtccaggcctccgtggacctctgtagagtgacaatgaatattagcacctcggataggagccacctttgggccgaggcttggctgcctcgcaattatactggacggttcgtctccactgggaacgggggcctggctggatgcgtgcaggaaacagacttgaatttcgctgccaactttggcttcgcaaccgttggcactaatggagggcacgatggagacacggcgaaatactttctgaataactctgaggtcctcgctgatttcgcctatcgcagcgttcacgagggcactgtggtcgggaagcaacttacccagttgttctacgacgaaggttacaattattcgtactatctgggctgcagcaccggaggcaggcaaggctatcagcaagtgcagcgctttccggatgactacgatggtgttattgccggaagtgcagcgatgaactttatcaatttgatttcttggggcgcttttctttggaaggccacgggactcgcagacgacccagattttatctcagcgaacctctggagcgttatccaccaggagattgtgcggcagtgtgacttggttgatggtgctcttgacggaattattgaagatcctgacttctgcgcccctgttatcgagagactgatttgtgatgggactaccaacggcacctcctgtatcactggggcacaagcggctaaagtgaatagggccctctcggacttttatggtccggatgggacagtctactatccacgcttgaactacggaggggaggcagactctgcgagcctgtacttcacaggctccatgtattcacggaccgaagagtggtacaagtacgtcgtgtacaacgatactaactggaatagttctcaatggacgctcgaaagcgctaagttggccttggagcagaacccctttaatattcaggcattcgaccctaatatcacagcgttcagggaccgcggtggaaaactcttgagctaccacggcacccaagatccgattatttcatcgactgacagcaagttgtattacagaagagttgctaacgcccttaacgctgccccatccgaactcgacgagttttatcgcttctttcagatctctgggatgggtcactgcggcgacggaaccggggcttcatacattggccagggatacggcacgtatacctcgaaggccccacaggtcaacttgcttcggactatggtggattgggttgagaatggaaaagctccggaatatatgcctgggaataagttgaacgccaacggttcgatcgagtatatgagaaagcactgtcgttacccaaaacacaatattcacacgggcccaggtaactacacggaccctaactcctggacctgcgtcagcgagaaggacgagctgtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtac

SEQ ID NO: 70 - DNA, 20454 bp, Artificial Sequence
  Synthetic construct, vector pAG2096
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagcacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaagtcgcatccacgcagggtatctctgaggacctgtataatcgcctcgtggaaatggccacaatttcacaagcggcttacgcagatctttgtaatatcccttcgacaattatcaagggagagaaaatctataacgcccagactgacatcaacggctggatactgcgggatgacacgagcaaggaaattatcacagtctttagagggaccggttccgatacaaatttgcagttggacacgaattacacactgacccccttcgatactctccctcaatgcaacgactgtgaggttcacggtgggtactatattggctggatctctgttcaagaccaagtcgagtcacttgttaagcagcaagcgtcgcagtacccggactacgcattgacggtgacagggcacagcctgggtgcctcgatggcagcgctcaccgctgcccagctttctgcaacctacgataatgtcaggctgtacactttcggagaaccacgctcaggcaaccaagcgtttgcttcgtatatgaacgacgctttccaggttagctcccccgagacgacacaatactttcgggtgacccattctaacgacgggattcctaacctcccgccagccgacgaaggttacgcacacgggggtgtcgagtactggtcagtggacccctacagcgcgcagaatactttcgtttgcacgggcgatgaggtccagtgctgtgaagctcaagggggtcagggagtgaatgatgcacacacaacctatttcggaatgacttccggggcttgcacgtggagcgagaaggacgagctgtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgccatggcacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaagtcgctactgatcccttccagtctcgctgtaacgagtttcaaaacaaaattgatatcgcaaacgtcacggttaggtcggtcgcctacgtcgcggctggtcagaatatctctcaagcagaagtcgcttcggtttgcaaggcaagcgtccaggcctccgtggacctctgtagagtgacaatgaatattagcacctcggataggagccacctttgggccgaggcttggctgcctcgcaattatactggacggttcgtctccactgggaacgggggcctggctggatgcgtgcaggaaacagacttgaatttcgctgccaactttggcttcgcaaccgttggcactaatggagggcacgatggagacacggcgaaatactttctgaataactctgaggtcctcgctgatttcgcctatcgcagcgttcacgagggcactgtggtcgggaagcaacttacccagttgttctacgacgaaggttacaattattcgtactatctgggctgcagcaccggaggcaggcaaggctatcagcaagtgcagcgctttccggatgactacgatggtgttattgccggaagtgcagcgatgaactttatcaatttgatttcttggggcgcttttctttggaaggccacgggactcgcagacgacccagattttatctcagcgaacctctggagcgttatccaccaggagattgtgcggcagtgtgacttggttgatggtgctcttgacggaattattgaagatcctgacttctgcgcccctgttatcgagagactgatttgtgatgggactaccaacggcacctcctgtatcactggggcacaagcggctaaagtgaatagggccctctcggacttttatggtccggatgggacagtctactatccacgcttgaactacggaggggaggcagactctgcgagcctgtacttcacaggctccatgtattcacggaccgaagagtggtacaagtacgtcgtgtacaacgatactaactggaatagttctcaatggacgctcgaaagcgctaagttggccttggagcagaacccctttaatattcaggcattcgaccctaatatcacagcgttcagggaccgcggtggaaaactcttgagctaccacggcacccaagatccgattatttcatcgactgacagcaagttgtattacagaagagttgctaacgcccttaacgctgccccatccgaactcgacgagttttatcgcttctttcagatctctgggatgggtcactgcggcgacggaaccggggcttcatacattggccagggatacggcacgtatacctcgaaggccccacaggtcaacttgcttcggactatggtggattgggttgagaatggaaaagctccggaatatatgcctgggaataagttgaacgccaacggttcgatcgagtatatgagaaagcactgtcgttacccaaaacacaatattcacacgggcccaggtaactacacggaccctaactcctggacctgcgtcagcgagaaggacgagctgtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtac

SEQ ID NO: 71 - DNA, 13540 bp, Artificial Sequence
  Synthetic construct, vector pAG2201
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatctttgtgaagaccctgaccggcaagactatcaccctcgaggtggagtcttctgacaccattgacaatgtcaaggccaagatccaggacaaggagggcatccccccagaccagcagcggctcatctttgctggcaagcagctggaggacgggcgcacgcttgcggactacaacatccagaaggagagcaccctccacctggtgctccgcctcaggggaggcatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 72 - DNA, 14683 bp, Artificial Sequence
  Synthetic construct, vector pAG2229
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggcggaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 73 - DNA, 14590 bp, Artificial Sequence
  Synthetic construct, vector pAG2233
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 74 - DNA, 14662 bp, Artificial Sequence
  Synthetic construct, vector pAG2234
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 75 - DNA, 17309 bp, Artificial Sequence
  Synthetic constrcut, vector pAG2242
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatctttgtgaagaccctgaccggcaagactatcaccctcgaggtggagtcttctgacaccattgacaatgtcaaggccaagatccaggacaaggagggcatccccccagaccagcagcggctcatctttgctggcaagcagctggaggacgggcgcacgcttgcggactacaacatccagaaggagagcaccctccacctggtgctccgcctcaggggaggcatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgggcttcgtgctcttctcccagctgccttccttccttcttgtctccaccctgctcttgttcctcgtgatctcccactcctgccgcgccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtac

SEQ ID NO: 76 - DNA, 13042 bp, Artificial Sequence
  Synthetic construct, vector pAG2252
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgtgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 77 - DNA, 13120 bp, Artificial Sequence
  Synthetic construct, vector pAG2253
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaggtgtgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 78 - DNA, 17111 bp, Artificial Sequence
  Synthetic construct, vector pAG2309
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtac

SEQ ID NO: 79 - DNA, 12892 bp, Artificial Sequence
  Synthetic construct, vector pAG2310
ctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatgac

SEQ ID NO: 80 - DNA, 21051 bp, Artificial Sequence
  Synthetic construct, vector pAG2339
catggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaggtgtgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtctcccaaactgcctgattataagaacgaccttctgtacgaacgcacattcgacgaggggctctgcttcccgtggcacacgtgcgaagattcaggagggaaatgcgattttgccgtggtcgacgttccaggcgagcctgggaacaaggcgttcaggctcactgttatcgataagggtcagaacaagtggtcggtccaaatgagacaccggggtatcacgttggagcaggggcacacatacaccgttcggtttactatctggagcgacaagagctgccgcgtgtatgccaaaatcggccaaatgggtgaaccctacacggagtactggaacaataactggaatccgttcaacctcactccggggcagaaattgacggtggaacagaactttactatgaattatcccacggacgacacgtgtgagtttaccttccacttgggaggggaactggcagccgggaccccttactacgtgtacctcgacgacgtttctctttacgatccccgctttgtcaagccagtggaatacgtcctgcctcaaccggatgtcagggttaatcaagttggatacctcccttttgctaagaaatatgctactgtcgtgtcatcgagcacgtccccattgaagtggcaacttctgaatagtgcaaaccaagttgtcttggagggcaatacaatccccaagggactggacaaagattcacaagactacgttcattggatcgatttctcgaactttaagaccgaaggcaaggggtactatttcaagttgcccactgtgaactccgatactaactactcccacccgtttgatatttctgcagatatctattcaaagatgaagttcgacgcgctcgctttcttttaccataaaaggtcgggaataccaatcgagatgccctacgccgggggagagcagtggacaaggcccgcagggcacattggtgtcgcgccgaacaagggcgacacgaatgtgccaacttggccccaggatgacgaatatgctggacgcccccagaaatactatacgaaagacgtgaccggcgggtggtacgatgccggtgaccacggcaagtacgtcgtgaacgggggtatcgcagtttggacccttatgaatatgtacgagagagcaaagattagaggaatcgctaaccagggtgcctacaaagatggaggaatgaatatcccggaaaggaataacggctatcctgatattctggacgaggccagatgggagatcgaattttttaagaagatgcaagtcactgagaaagaagatccgtcgattgcaggtatggtgcaccacaagatccacgatttcaggtggacggcgctcggaatgttgcctcacgaggacccccagccacgctaccttcggcccgtcagcacagcggcaaccctgaatttcgcagcgaccctcgctcagtctgccagattgtggaaggattacgacccgacttttgcagcggactgccttgagaaagctgaaattgcctggcaagcagcactcaaacacccggacatctacgctgagtacacgccaggaagcggtgggccgggtggaggtccttataatgacgattatgtcggggacgagttctactgggccgcttgtgaactctatgtgacaaccggtaaggatgagtacaagaattacttgatgaatagtccgcactatctggaaatgccagcgaagatgggcgagaacggaggggctaacggcgaggacaacggtctctggggctgctttacttggggaacgacacaggggttgggtacaattacccttgccctcgttgaaaacggcctcccttcggcggatattcaaaaggcccgcaacaatatcgctaaagccgcagataagtggcttgagaatattgaagaacaaggttaccgcctgcctatcaaacaagcggaggatgaacggggcggatacccgtggggtagtaattctttcattctcaaccagatgatcgtcatgggctacgcttacgacttcacgggaaacagcaagtatcttgacgggatgcaggacggcatgtcctacctgctcggtagaaacggacttgatcaatcgtacgttactgggtacggggagaggccacttcagaacccccacgaccgcttttggacccctcaaacttcgaagaaattcccggccccaccccctggtattatcgcaggcgggccgaatagccggtttgaagatccaacgatcactgcagcggttaagaaggatacacccccgcagaagtgctatattgaccacaccgattcctggtctactaacgagatcacgattaattggaacgcccccttcgcgtgggtcacagcgtatctggacgaaattgacttgattaccccacccggcggagtggaccctgaagagccggaagttatctacggtgattgtaacggcgacggaaaggttaattcgaccgatgctgtggcccttaaaaggtatatcctccgcagcggtatctcgatcaacacggacaacgcggacgttaatgcagatggtcgcgtgaatagcactgacctcgctattttgaagcgctatattttgaaggagatcgatgttcttcctcacaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgc

SEQ ID NO: 81 - DNA, 17129 bp, Artificial Sequence
  Synthetic construct, vector pAG2342
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtac

SEQ ID NO: 82 - DNA, 21841 bp, Artificial Sequence
  Synthetic construct, vector pAG2345
tcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaagtcttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtctcccaaactgcctgattataagaacgaccttctgtacgaacgcacattcgacgaggggctctgcttcccgtggcacacgtgcgaagattcaggagggaaatgcgattttgccgtggtcgacgttccaggcgagcctgggaacaaggcgttcaggctcactgttatcgataagggtcagaacaagtggtcggtccaaatgagacaccggggtatcacgttggagcaggggcacacatacaccgttcggtttactatctggagcgacaagagctgccgcgtgtatgccaaaatcggccaaatgggtgaaccctacacggagtactggaacaataactggaatccgttcaacctcactccggggcagaaattgacggtggaacagaactttactatgaattatcccacggacgacacgtgtgagtttaccttccacttgggaggggaactggcagccgggaccccttactacgtgtacctcgacgacgtttctctttacgatccccgctttgtcaagccagtggaatacgtcctgcctcaaccggatgtcagggttaatcaagttggatacctcccttttgctaagaaatatgctactgtcgtgtcatcgagcacgtccccattgaagtggcaacttctgaatagtgcaaaccaagttgtcttggagggcaatacaatccccaagggactggacaaagattcacaagactacgttcattggatcgatttctcgaactttaagaccgaaggcaaggggtactatttcaagttgcccactgtgaactccgatactaactactcccacccgtttgatatttctgcagatatctattcaaagatgaagttcgacgcgctcgctttcttttaccataaaaggtcgggaataccaatcgagatgccctacgccgggggagagcagtggacaaggcccgcagggcacattggtgtcgcgccgaacaagggcgacacgaatgtgccaacttggccccaggatgacgaatatgctggacgcccccagaaatactatacgaaagacgtgaccggcgggtggtacgatgccggtgaccacggcaagtacgtcgtgaacgggggtatcgcagtttggacccttatgaatatgtacgagagagcaaagattagaggaatcgctaaccagggtgcctacaaagatggaggaatgaatatcccggaaaggaataacggctatcctgatattctggacgaggccagatgggagatcgaattttttaagaagatgcaagtcactgagaaagaagatccgtcgattgcaggtatggtgcaccacaagatccacgatttcaggtggacggcgctcggaatgttgcctcacgaggacccccagccacgctaccttcggcccgtcagcacagcggcaaccctgaatttcgcagcgaccctcgctcagtctgccagattgtggaaggattacgacccgacttttgcagcggactgccttgagaaagctgaaattgcctggcaagcagcactcaaacacccggacatctacgctgagtacacgccaggaagcggtgggccgggtggaggtccttataatgacgattatgtcggggacgagttctactgggccgcttgtgaactctatgtgacaaccggtaaggatgagtacaagaattacttgatgaatagtccgcactatctggaaatgccagcgaagatgggcgagaacggaggggctaacggcgaggacaacggtctctggggctgctttacttggggaacgacacaggggttgggtacaattacccttgccctcgttgaaaacggcctcccttcggcggatattcaaaaggcccgcaacaatatcgctaaagccgcagataagtggcttgagaatattgaagaacaaggttaccgcctgcctatcaaacaagcggaggatgaacggggcggatacccgtggggtagtaattctttcattctcaaccagatgatcgtcatgggctacgcttacgacttcacgggaaacagcaagtatcttgacgggatgcaggacggcatgtcctacctgctcggtagaaacggacttgatcaatcgtacgttactgggtacggggagaggccacttcagaacccccacgaccgcttttggacccctcaaacttcgaagaaattcccggccccaccccctggtattatcgcaggcgggccgaatagccggtttgaagatccaacgatcactgcagcggttaagaaggatacacccccgcagaagtgctatattgaccacaccgattcctggtctactaacgagatcacgattaattggaacgcccccttcgcgtgggtcacagcgtatctggacgaaattgacttgattaccccacccggcggagtggaccctgaagagccggaagttatctacggtgattgtaacggcgacggaaaggttaattcgaccgatgctgtggcccttaaaaggtatatcctccgcagcggtatctcgatcaacacggacaacgcggacgttaatgcagatggtcgcgtgaatagcactgacctcgctattttgaagcgctatattttgaaggagatcgatgttcttcctcacaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgc

SEQ ID NO: 83 - DNA, 20699 bp, Artificial Sequence
  Synthetic construct, vector pAG2349
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaagtcttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 84 - DNA, 14002 bp, Artificial Sequence
  Synthetic construct, vector pAG2042
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgctggaggaggatactggcacacttccggcagggagatcctcgacgcaaataacgttccagtcagaatcgccgggattaattggtttggcttcgaaacgtgtaactacgtggttcacggcctgtggtctcgggattacagatcaatgctcgaccagatcaaatccttggggtataatacaattaggctgccctacagcgatgacattcttaagcctggaaccatgccgaactcgattaatttctaccaaatgaaccaggatctgcagggattgacttctctgcaggttatggacaagatcgtggcgtacgccggccaaatcgggctcagaattattttggatcggcacaggccagactgctcaggtcagtcggccctgtggtacacaagctccgtgtcagaggcaacatggatttcagatcttcaagccctcgcacaacgctataaaggcaaccccacggttgtgggattcgaccttcacaacgaacctcacgatccggcctgttggggctgcggggacccttcgatcgactggagactggcagcggagagggctggtaacgccgttctcagcgtcaatcccaacttgctgatctttgtggagggagttcagtcctacaacggcgattcttactggtggggcggaaatctccaaggcgcagggcagtatcctgtcgtgcttaacgttccgaatcgcctggtctactcagcacacgactacgcgactagcgtgtacccacagacgtggttctccgatcccacatttcctaacaatatgccgggaatctggaacaagaattggggttacttgtttaaccaaaacattgctccagtttggttgggtgaatttggcaccactcttcagtcgacgacagaccaaacctggctgaaaaccctcgtccagtatttgcggccaactgctcagtacggagcagattcttttcaatggacgttctggtcttggaatcctgactccggggatacaggcggtatcctgaaagacgattggcagaccgtggacactgttaaggacgggtacttggcgccgattaaaagctcgatctttgacccagtcggcgctagcgcttccccatcttcacaaccttcgccgagcgtcagccccagcccaagcccaagcccgtctgccagcagaacccccactcccacacctacccccacggcctcaccaactccgacgctcactcctacggcgacgccaacaccaactgcttcacccactcctagccccaccgcagcgagcggggctaggtgcaccgcttcttaccaggtcaactctgactggggtaatggcttcaccgtgactgtggcggtcactaactcaggaagcgtcgcgacgaaaacctggactgtgtcctggacgttcgggggcaaccaaacaatcaccaacagctggaacgctgcagttacgcagaatgggcaaagcgtcacggcgcgcaatatgagctacaacaacgtgattcaaccaggccagaataccacattcggttttcaagcaagctataccgggtcaaacgctgccccaactgtcgcttgtgctgcctcatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 85 - DNA, 9983 bp, Artificial Sequence
  Synthetic construct, vector pAG2004
ccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccatcaatcccgggtattcatcctaggtatccaagaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccag

What is claimed is:

1. An engineered plant including a first polynucleotide sequence encoding an amino acid sequence with at least 90% identity to a first reference sequence selected from the group consisting of: SEQ ID NO: 7 and SEQ ID NO: 8.

2. The engineered plant of claim 1 further including a second polynucleotide sequence encoding an amino acid sequence with at least 90% identity to a second reference sequence selected from the group consisting of: SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, and SEQ ID: 12, wherein the SEQ ID NO selected as the second reference sequence is different than the SEQ ID NO selected as the first reference sequence.

3. The engineered plant of claim 2 further comprising a third polynucleotide sequence encoding an amino acid sequence with at least 90% identity to a third reference sequence selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, and SEQ ID: 12, wherein the SEQ ID NO selected as the third reference sequence is different than the SEQ ID NO selected as the first reference sequence and different than the SEQ ID NO selected as the second reference sequence.

4. The engineered plant of claim 1, wherein the first polynucleotide sequence, the second polynucleotide sequence, or the third polynucleotide sequence further includes a targeting polynucleotide sequence encoding a targeting peptide selected from the group consisting of: an amyloplast targeting signal, a cell wall targeting peptide, a mitochondrial targeting peptide, a cytosol localization signal, a chloroplast targeting signal, a nuclear targeting peptide, and a vacuole targeting peptide.

5. The engineered plant of claim 4, wherein the targeting peptide is selected from the group consisting of: SEQ ID NO: 13, SEQ ID NO: 14, SEQ ID NO: 15, SEQ ID NO: 16, SEQ ID NO: 17, SEQ ID NO: 22, SEQ ID NO: 23, and SEQ ID NO: 24.

6. The engineered plant of claim 1, wherein the engineered plant is selected from the group consisting of: corn, sugar cane, sugar beet, sorghum, switchgrass, *miscanthus*, *eucalyptus*, willow and poplar.

7. The engineered plant of claim 1, wherein the first polynucleotide sequence encodes the amino acid sequence with at least 90% identity to the first reference sequence of SEQ ID NO: 7.

8. The engineered plant of claim 2, wherein the first polynucleotide sequence encodes the amino acid sequence with at least 90% identity to the first reference sequence of SEQ ID NO: 7 and the second polynucleotide sequence encodes the amino acid sequence with at least 90% identity to the second reference sequence of SEQ ID NO: 8.

9. The engineered plant of claim 1, wherein the first polynucleotide sequence encodes the amino acid sequence with at least 90% identity to the first reference sequence of SEQ ID NO: 8.

10. The engineered plant of claim 2, wherein the second polynucleotide sequence encodes the amino acid sequence with at least 90% identity to the second reference sequence of SEQ ID NO: 1.

11. The engineered plant of claim 2, wherein the second polynucleotide sequence encodes the amino acid sequence with at least 90% identity to the second reference sequence of SEQ ID NO: 2.

12. The engineered plant of claim 2, wherein the second polynucleotide sequence encodes the amino acid sequence with at least 90% identity to the second reference sequence of SEQ ID NO: 3.

13. The engineered plant of claim 2, wherein the second polynucleotide sequence encodes the amino acid sequence with at least 90% identity to the second reference sequence of SEQ ID NO: 4.

14. The engineered plant of claim 2, wherein the second polynucleotide sequence encodes the amino acid sequence with at least 90% identity to the second reference sequence of SEQ ID NO: 5.

15. The engineered plant of claim 2, wherein the second polynucleotide sequence encodes the amino acid sequence with at least 90% identity to the second reference sequence of SEQ ID NO: 6.

16. The engineered plant of claim 2, wherein the second polynucleotide sequence encodes the amino acid sequence with at least 90% identity to the second reference sequence of SEQ ID NO: 9.

17. The engineered plant of claim 2, wherein the second polynucleotide sequence encodes the amino acid sequence with at least 90% identity to the second reference sequence of SEQ ID NO: 10.

18. The engineered plant of claim 2, wherein the second polynucleotide sequence encodes the amino acid sequence with at least 90% identity to the second reference sequence of SEQ ID NO: 11.

19. The engineered plant of claim 2, wherein the second polynucleotide sequence encodes the amino acid sequence with at least 90% identity to the second reference sequence of SEQ ID: 12.

20. The engineered plant of claim 3, wherein the third polynucleotide sequence encodes the amino acid sequence with at least 90% identity to the third reference sequence of SEQ ID NO: 1.

21. The engineered plant of claim 3, wherein the third polynucleotide sequence encodes the amino acid sequence with at least 90% identity to the third reference sequence of SEQ ID NO: 2.

22. The engineered plant of claim 3, wherein the third polynucleotide sequence encodes the amino acid sequence with at least 90% identity to the third reference sequence of SEQ ID NO: 3.

23. The engineered plant of claim 3, wherein the third polynucleotide sequence encodes the amino acid sequence with at least 90% identity to the third reference sequence of SEQ ID NO: 4.

24. The engineered plant of claim 3, wherein the third polynucleotide sequence encodes the amino acid sequence with at least 90% identity to the third reference sequence of SEQ ID NO: 5.

25. The engineered plant of claim 3, wherein the third polynucleotide sequence encodes the amino acid sequence with at least 90% identity to the third reference sequence of SEQ ID NO: 6.

26. The engineered plant of claim 3, wherein the third polynucleotide sequence encodes the amino acid sequence with at least 90% identity to the third reference sequence of SEQ ID NO: 7.

27. The engineered plant of claim 3, wherein the third polynucleotide sequence encodes the amino acid sequence with at least 90% identity to the third reference sequence of SEQ ID NO: 8.

28. The engineered plant of claim 3, wherein the third polynucleotide sequence encodes the amino acid sequence with at least 90% identity to the third reference sequence of SEQ ID NO: 9.

29. The engineered plant of claim 3, wherein the third polynucleotide sequence encodes the amino acid sequence with at least 90% identity to the third reference sequence of SEQ ID NO: 10.

30. The engineered plant of claim 3, wherein the third polynucleotide sequence encodes the amino acid sequence with at least 90% identity to the third reference sequence of SEQ ID NO: 11.

31. The engineered plant of claim 3, wherein the third polynucleotide sequence encodes the amino acid sequence with at least 90% identity to the third reference sequence of SEQ ID: 12.

32. The engineered plant of claim 3, wherein the first polynucleotide sequence encodes the amino acid sequence with at least 90% identity to the first reference sequence of SEQ ID NO: 7, the second polynucleotide sequence encodes the amino acid sequence with at least 90% identity to the second reference sequence of SEQ ID NO: 4, and the third polynucleotide sequence encodes the amino acid with at least 90% identity to the third reference sequence of SEQ ID NO: 5.

33. The engineered plant of claim 32, wherein the first polynucleotide sequence encodes the amino acid of SEQ ID NO: 7, the second polynucleotide sequence encodes the amino acid sequence of SEQ ID NO: 4, and the third polynucleotide sequence encodes the amino acid of SEQ ID NO: 5.

34. The engineered plant of claim 3, wherein the first polynucleotide sequence encodes the amino acid sequence with at least 90% identity to the first reference sequence of SEQ ID NO: 8, the second polynucleotide sequence encodes the amino acid sequence with at least 90% identity to the second reference sequence of SEQ ID NO: 4, and the third polynucleotide sequence encodes the amino acid with at least 90% identity to the third reference sequence of SEQ ID NO: 5.

35. The engineered plant of claim 34, wherein the first polynucleotide sequence encodes the amino acid of SEQ ID NO: 8, the second polynucleotide sequence encodes the amino acid sequence of SEQ ID NO: 4, and the third polynucleotide sequence encodes the amino acid of SEQ ID NO: 5.

* * * * *